United States Patent 11,692,002 (RNA SEQUENCE ADAPTATION) - sequence listing, part 8

SEQ ID NO: 28143 - RNA, 1410 nt, Artificial Sequence
  derived and/or modified CDS sequence (AUadapt) from InfluenzaA__AIM56097__NA
augaaccccaaccagaagaucaucaccaucggcucggugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcggagcaguccguggugagcgucaagcuggccggcaacuccucgcucugcccgguguccgggugggccaucuacagcaaggacaacuccgugcgcaucggcagcaagggcgacgucuucgugauccgggagcccuucaucuccugcagcccccuggagugccgcaccuucuuccugacccagggggcccuccugaacgacaagcacuccaacggcaccaucaaggaccggagccccuaccgcacgcugauguccugcccgaucggggaggugcccagccccuacaacucgcgguucgaguccgucgccuggagcgcguccgccugccacgacggcaucaacuggcucaccaucgggaucagcggccccgacuccggcgccguggccgugcugaaguacaacgggaucaucaccgacaccaucaagagcuggcgcaacaacauccugcggacgcaggaguccgagugcgcgugcgucaacggcagcugcuucaccaucaugaccgacgggccguccgacggccaggccagcuacaagaucuuccgcaucgagaagggcaagaucgugaaguccguggagaugaacgcccccaacuaccacuacgaggagugcucgugcuaccccgacuccagcgagaucacgugcgucugccgggacaacuggcacggguccaaccgccccugggugagcuucaaccagaaccucgaguaccagaucggcuacaucugcuccgggguguucggcgacaacccgcggcccaacgacaagaccgggagcugcggccccgucuccagcaacggcgccaacggggugaagggcuucagcuucaaguacgggaacggcguguggaucgggcgcaccaaguccaucucgucccggaagggcuucgagaugaucugggaccccaacggcuggaccgggaccgacaacaacuucagcaucaagcaggacaucgucggcaucaaggagugguccggguacagcggcuccuucgugcagcacccggagcugacggggcuggacugcauccgccccugcuucugggucgagcucauccggggccgccccgaggagaacaccaucuggaccagcggcuccagcaucuccuucugcggggugaacagcgacaccgugggcugguccuggcccgacggggccgagcugccguucacgaucgacaaguga

SEQ ID NO: 28144 - RNA, 1410 nt, Artificial Sequence
  derived and/or modified CDS sequence (AUadapt) from InfluenzaA__AIM56108__NA
augaaccccaaccagaagaucaucaccaucggcucggugugcaugaccaucgggauggccaaccugauccuccagaucggcaacaucaucuccaucugggucagccacuccauccagcuggggaaccagagccagaucgagacgugcaaccaguccgugaucaccuacgagaacaacaccuggaucaaccagaccuacgugaacaucagcaacacgaacuucgccgcgggccaguccgucgugccggugaagcuggccgggaacucgucccucugccccgucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccgguccccguaccgcacgcugaugucgugccccaucggcgaggugcccucccccuacaacagccgguucgagagcguggccugguccgcgagcgccugccacgacgggaucaacuggcucaccaucggcaucuccggcccggacagcggggccgucgccgugcugaaguacaacggcaucaucaccgacaccaucaaguccuggcgcaacaacauccugcggacgcaggagucggagugcgcgugcgugaacggguccugcuucaccaucaugaccgacggccccagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgcccgugggucuccuucaaccagaaccucgaguaccagaucggguacaucugcucgggcguguucggggacaacccccggcccaacgacaagaccggcuccugcggccccgugagcuccaacggggccaacggcgucaagggguucagcuucaaguacggcaacgggguguggaucggccgcaccaagagcaucuccagccggaagggcuucgagaugaucugggacccgaacggguggaccggcaccgacaacaacuucuccaucaagcaggacaucguggggaucaaggaguggucgggcuacuccgggagcuucguccagcaccccgagcugacgggccuggacugcauccgccccugcuucuggguggagcucauccggggccgccccgaggagaacaccaucuggaccuccgggagcuccaucagcuucugcggcgucaacuccgacaccgugggguggagcuggccggacggcgccgagcugcccuucacgaucgacaaguga

SEQ ID NO: 28145 - RNA, 1410 nt, Artificial Sequence
  derived and/or modified CDS sequence (AUadapt) from InfluenzaA__AIM56119__NA
augaaccccaaccagaagaucaucaccaucggcucggugugcaugaccaucgggauggccaaccugauccuccagaucggcaacaucaucuccaucugggucagccacuccauccagaucgggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccucgcugugcccgguguccggcugggccaucuacagcaaggacaacuccgugcgcaucggcagcaagggggacgucuucgugauccgggagcccuucaucuccugcagcccccucgagugccgcaccuucuuccugacccagggcgcccugcucaacgacaagcacuccaacgggaccaucaaggaccggagccccuaccgcacgcugauguccugcccgaucggcgaggugcccagccccuacaacucgcgguucgaguccgucgccuggagcgcguccgccugccacgacgggaucaacuggcugaccaucggcaucagcggccccgacuccggggccguggccgugcucaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccuggaguaccagaucggguacaucugcuccggcguguucggggacaacccgcggcccaacgacaagaccggcagcugcggccccgucuccagcaacggggccaacggcgugaagggguucagcuucaaguacggcaacgggguguggaucggccgcaccaaguccaucucgucccggaagggcuucgagaugaucugggaccccaacggguggaccggcaccgacaacaaguucagcaucaagcaggacaucgucgggaucaacgagugguccggcuacagcggguccuucgugcagcacccggagcucacgggccuggacugcauccgccccugcuucugggucgagcugauccggggccgccccgaggagaacaccaucuggaccagcggguccagcaucuccuucugcggcgugaacagcgacaccguggggugguccuggcccgacggcgccgagcucccguucacgaucgacaaguga

SEQ ID NO: 28146 - RNA, 1410 nt, Artificial Sequence
  derived and/or modified CDS sequence (AUadapt) from InfluenzaA__AIM56130__NA
augaaccccaaccagaagaucaucaccaucggcucggugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugccggucaagcuggccgggaacucgucccucugccccgugagcggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacucgaacgggaccaucaaggaccgguccccguaccgcacgcugaugagcugccccaucggcgaggugcccucccccuacaacagccgguucgagagcgucgccugguccgcgagcgccugccacgacgggaucaacuggcucaccaucggcaucuccggcccggacucgggggccguggccgugcugaaguacaacggcaucaucaccgacaccaucaaguccuggcgcaacaacauccugcggacgcaggagagcgagugcgcgugcgucaacggguccugcuucaccaucaugaccgacggccccagcgacggccaggccuccuacaagaucuuccgcaucgagaaggggaagaucgugaaguccguggagaugaacgcccccaacuaccacuacgaggagugcuccugcuaccccgacagcuccgagaucacgugcgucugccgggacaacuggcacggcagcaaccgcccguggguguccuucaaccagaaccucgaguaccagaucggguacaucugcucgggcguguucggggacaacccccggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggacccgaacggguggaccggcaccgacaacaaguucuccaucaagcaggacaucgucgggaucaacgaguggucgggcuacuccgggagcuucgugcagcaccccgagcugacgggccuggacugcauccgccccugcuucugggucgagcucauccggggccgccccgaggagaacaccaucuggaccuccgggagcuccaucagcuucugcggcgugaaguccgacaccgugggguggagcuggccggacggcgccgagcugcccuucacgaucgacaaguga

SEQ ID NO: 28147 - RNA, 1410 nt, Artificial Sequence
  derived and/or modified CDS sequence (AUadapt) from InfluenzaA__AIM56141__NA
augaaccccaaccagaagaucaucaccaucggcucggugugcaugaccaucgggauggccaaccugauccuccagaucggcaacaucaucuccaucugggucagccacuccauccagcuggggaaccagagccagaucgagacgugcaaccaguccgugaucaucuacgagaacaacaccugggugaaccagaccuacgucaacaucagcaacaccaacuucgccgcgggccaguccguggugagcgucaagcuggccgggaacuccagccucugcccgguguccggcugggccaucuacagcaaggacaacuccgugcgcaucggcucgaagggggacgucuucgugauccgggagcccuucaucuccugcagcccccuggagugccgcacguucuuccugacccagggcgcccuccugaacgacaagcacuccaacgggaccaucaaggaccggagccccuaccgcacccugauguccugcccgaucggcgaggugcccagccccuacaacagccgguucgaguccgucgccuggagcgcguccgccugccacgacgggaucaacuggcucacgaucggcaucagcggccccgacuccggggccguggccgugcugaaguacaacggcaucaucaccgacaccaucaagucguggcgcaacaacauccugcggacccaggaguccgagugcgcgugcgucaacgggagcugcuucacgaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcguguucggggacaacccgcggcccaacgacaagaccggcagcugcggccccgucuccucgaacggggccaacggcgugaagggguucagcuucaaguacggcaacgggguguggaucggccgcaccaaguccaucagcucccggaagggcuucgagaugaucugggaccccaacggguggaccggcaccgacaacaacuucagcaucaagcaggacaucgucgggaucaaggagugguccggcuacagcggguccuucgugcagcacccggagcugaccggccuggacugcauccgccccugcuucugggucgagcucauccggggccgccccgaggagaacacgaucuggaccagcggguccagcaucuccuucugcggcgugaacagcgacaccguggggugguccuggcccgacggcgccgagcugccguucaccaucgacaaguga

SEQ ID NO: 28148 - RNA, 1410 nt, Artificial Sequence; identical to SEQ ID NO: 28133
  derived and/or modified CDS sequence (AUadapt) from InfluenzaA__AIM56152__NA

SEQ ID NO: 28149 - RNA, 1410 nt, Artificial Sequence
  derived and/or modified CDS sequence (AUadapt) from InfluenzaA__AIM56163__NA
augaaccccaaccagaagaucaucaccaucggcucggugugcaugaccaucgggauggccaaccugauccuccagaucggcaacaucaucuccaucugggucagccacuccauccagcuggggaaccagagccacaucgagacgugcaaccaguccgugaucaccuacgagaacaacaccugggugaaccagaccuacgucaacaucagcaacacgaacuucgccgcgggccaguccguggugccggucaagcuggccgggaacucgucccucugccccgugagcggcugggccaucuacuccaaggacaacagcgugcgcaucggcuccaagggggacgucuucgugauccgggagcccuucaucagcugcucgccccuggagugccgcaccuucuuccugacccagggcgcccuccugaacgacaagcacuccaacgggaccaucaaggaccgguccccguaccgcacgcugaugagcugccccaucggcgaggugcccucccccuacaacagccgguucgagagcgucgccugguccgcgucggccugccacgacgggaucaacuggcucaccaucggcaucuccggcccggacaacggggccguggccgugcugaaguacaacggcaucaucaccgacaccaucaagagcuggcgcaacaacauccugcggacgcaggaguccgagugcgcgugcgucaacgggagcugcuucaccaucaugaccgacggccccuccgacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgcccgugggugagcuucaaccagaaccucgaguaccagaucggguacaucugcuccggcguguucggggacaacccccggcccaacgacaagaccggcagcugcggccccgucaccuccaacggggccaacggcgugaagggguucucguucaaguacggcaacgggguguggaucggccgcaccaaguccaucagcagccggaagggcuucgagaugaucugggacccgaacggguggaccggcacggacaacaacuucuccaucaagcaggacaucgucgggaucaaggaguggagcggcuacuccgggucguucgugcagcaccccgagcugaccggccuggacugcauccgccccugcuucugggucgagcucauccggggccgccccgaggagaacaccaucuggaccuccgggagcuccaucagcuucugcggcgugaacuccgacacggugggguggagcuggccggacggcgccgagcugcccuucaccaucgacaaguga

SEQ ID NO: 28150 - RNA, 1410 nt, Artificial Sequence
  derived and/or modified CDS sequence (AUadapt) from InfluenzaA__AIM56174__NA
augaaccccaaccagaagaucaucaccaucggcucggugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugccggucaagcuggccgggaacucgucccucugccccgugagcggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacucgaacgggaccaucaaggaccgguccccguaccgcacgcugaugagcugccccaucggcgaggugcccucccccuacaacagccgguucgagagcgucgccugguccgcgagcgccugccacgacgggaucaacuggcucaccaucggcaucuccggcccggacucgggggccguggccgugcugaaguacaacggcaucaucaccgacaccaucaaguccuggcgcaacaacauccugcggacgcaggagagcgagugcgcgugcgucaacggguccugcuucaccaucaugaccgacggccccagcgacggccaggccuccuacaagaucuuccgcaucgagaaggggaagaucgugaaguccguggagaugaacgcccccaacuaccacuacgaggagugcuccugcuaccccgacagcuccgagaucacgugcgucugccgggacaacuggcacggcagcaaccgcccguggguguccuucaaccagaaccucgaguaccagaucggguacaucugcucgggcguguucggggacaacccccggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggacccgaacggguggaccggcaccgacaacaacuucuccaucaagcaggacaucgucgggaucaaggaguggucgggcuacuccgggagcuucgugcagcaccccgagcugacgggccuggacugcauccgccccugcuucugggucgagcucauccggggccgccccgaggagaacaccaucuggaccuccgggagcuccaucagcuucugcggcgugaacuccgacaccgugggguggagcuggccggacggcgccgagcugcccuucacggucgacaaguga

SEQ ID NO: 28151 - RNA, 1410 nt, Artificial Sequence; identical to SEQ ID NO: 28146
  derived and/or modified CDS sequence (AUadapt) from InfluenzaA__AIM56185__NA

SEQ ID NO: 28152 - RNA, 1410 nt, Artificial Sequence; identical to SEQ ID NO: 28145
  derived and/or modified CDS sequence (AUadapt) from InfluenzaA__AIM56196__NA

SEQ ID NO: 28153 - RNA, 1410 nt, Artificial Sequence; identical to SEQ ID NO: 28127
  derived and/or modified CDS sequence (AUadapt) from InfluenzaA__AIM56207__NA

SEQ ID NO: 28154 - RNA, 1410 nt, Artificial Sequence
  derived and/or modified CDS sequence (AUadapt) from InfluenzaA__AIM56229__NA
augaaccccaaccagaagaucaucaccaucggcucggugugcaugaccaucgggauggccaaccugauccuccagaucggcaacacgaucuccaucugggucagccacuccauccagaucgggaaccagagccagaucgagaccugcaaccaguccgugaucaccuacgagaacaacaccugggugaaccagacguacgucaacaucagcaacaccaacuucgccgcgggccaguccguggugucggucaagcuggccgggaacuccagccugugcccgguguccggcugggccaucuacagcaaggacaacuccgugcgcaucggcagcaagggggacgucuucgugauccgggagcccuucaucuccugcagcccccucgagugccgcaccuucuuccugacccagggcgcccugcucaacgacaagcacuccaacgggacgaucaaggaccggucgcccuaccgcacccugauguccugcccgaucggcgaggugcccagccccuacaacagccgguucgaguccgucgccuggagcgcguccgccugccacgacgggaucaacuggcugaccaucggcaucagcggccccgacuccggggccguggccgugcucaaguacaacggcaucaucaccgacacgaucaagucguggcgcaacaacauccugcggacccaggaguccgagugcgcgugcgucaacgggagcugcuucaccaucaugaccgacggcccguccgacggccacgccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccuggaguaccagaucggguacaucugcuccggcguguucggggacaacccgcggcccaacgacaagaccggcagcugcggccccgucuccagcaacggggccaacggcgugaagggguucagcuucaaguacggcaacgggguguggaucggccgcaccaaguccaucagcucccggaagggcuucgagaugaucugggaccccaacggguggaccggcacggacaacaaguucucgaucaagcaggacaucgucgggaucaacgagugguccggcuacagcggguccuucgugcagcacccggagcucaccggccuggacugcauccgccccugcuucugggucgagcugauccggggccgccccgaggagaacaccaucuggaccagcggguccagcaucuccuucugcggcgugaacagcgacacgguggggugguccuggcccgacggcgccgagcucccguucaccaucgacaaguga

SEQ ID NO: 28155 - RNA, 1410 nt, Artificial Sequence
  derived and/or modified CDS sequence (AUadapt) from InfluenzaA__AIM56240__NA
augaaccccaaccagaagaucaucaccaucggcucggugugcaugaccaucgggauggccaaccugauccuccagaucggcaacaucaucuccaucuggaucagccacuccauccaggucgggaaccagagccagaucgagacgugcaaccaguccgugaucaccuacgagaacaacaccugggugaaccagaccuacgucaacaucagcaacacgaacuucgccgcgggccagccggugguguccgucaagcuggccgggaacagcucccugugcucgguguccggcugggccaucuacagcaaggacaacuccgugcgcaucggcagcaagggggacgucuucgugauccgggagcccuucaucuccugcagcccccucgagugccgcaccuucuuccugacccagggcgcccugcucaacgacaagcacuccaacgggaccaucaaggaccggagccccuaccgcacgcugauguccugcccgaucggcgaggugcccagccccuacaacucgcgguucgaguccgucgccuggagcgcguccgccugccacgacgggaucaacuggcugaccaucggcaucagcggccccgacuccggggccguggccgugcucaaguacaacggcaucaucaccgacaccaucaagagcuggcgcaacgacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccuggaguaccagaucggguacaucugcuccggcaucuucggggacaacccgcggcccaacgacaagaccggcagcugcggccccguguccagcaacggggccaacggcgucaagggguucagcuucaaguacggcaacgggguguggaucggccgcaccaaguccaucucgucccggaagggcuucgagaugaucugggaccccaacggguggaccggcaccgacaacaacuucagcaucaagcaggacaucguggggaucaacgagugguccggcuacagcggguccuucguccagcacccggagcucacgggccuggacugcauccgccccugcuucuggguggagcugauccggggccgccccaaggagaacaccaucuggaccagcggguccagcaucuccuucugcggcgucaacagcgacaccguggggugguccuggcccgacggcgccgagcucccguucacgaucgacaaguga

SEQ ID NO: 28156 - RNA, 1410 nt, Artificial Sequence
  derived and/or modified CDS sequence (AUadapt) from InfluenzaA__AIM56251__NA
augaaccccaaccagaagaucaucaccaucggcucggugugcaugaccaucgggauggccaaccugauccuccagaucggcaacaucaucuccaucugggucagccacuccauccagcuggggaaccagagccacaucgagacgugcaaccaguccgugaucaccuacgagaacaacaccugggugaaccagaccuacgucaacaucagcaacacgaacuucgccgcgggccaguccguggugccggucaagcuggccgggaacucgucccucugccccgugagcggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacucgaacgggaccaucaaggaccgguccccguaccgcacgcugaugagcugccccaucggcgaggugcccucccccuacaacagccgguucgagagcgucgccugguccgcgagcgccugccacgacgggaucaacuggcucaccaucggcaucuccggcccggacucgggggccguggccgugcugaaguacaacggcaucaucaccgacaccaucaaguccuggcgcaacaacauccugcggacgcaggagagcgagugcgcgugcgucaacggguccugcuucaccaucaugaccgacggccccagcgacggccaggccuccuacaagaucuuccgcaucgagaaggggaagaucgugaaguccguggagaugaacgcccccaacuaccacuacgaggagugcuccugcuaccccgacagcuccgagaucacgugcgucugccgggacaacuggcacggcagcaaccgcccguggguguccuucaaccagaaccucgaguaccagaucggguacaucugcucgggcguguucggggacaacccccggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggacccgaacggguggaccggcaccgacaacaacuucuccaucaagcaggacaucgucgggaucaaggaguggucgggcuacuccgggagcuucgugcagcaccccgagcugacgggccuggacugcauccgccccugcuucugggucgagcucauccggggccgccccgaggagaacaccaucuggaccuccgggagcuccaucagcuucugcggcgugaacuccgacaccgugggguggagcuggccggacggcgccgagcugcccuucacgaucgacaaguga

SEQ ID NO: 28157 - RNA, 1410 nt, Artificial Sequence; identical to SEQ ID NO: 28156
  derived and/or modified CDS sequence (AUadapt) from InfluenzaA__AIM56262__NA

SEQ ID NO: 28158 - RNA, 1410 nt, Artificial Sequence; identical to SEQ ID NO: 28127
  derived and/or modified CDS sequence (AUadapt) from InfluenzaA__AIM56273__NA

SEQ ID NO: 28159 - RNA, 1410 nt, Artificial Sequence
  derived and/or modified CDS sequence (AUadapt) from InfluenzaA__AIM56284__NA
augaaccccaaccagaagaucaucaccaucggcucggugugcaucaccaucgggauggccaaccugauccuccagaucggcaacaucaucuccaucugggucagccacuccauccagaucgggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccucgcugugcccgguguccggcugggccaucuacagcaaggacaacuccgugcgcaucggcagcaagggggacgucuucgugauccgggagcccuucaucuccugcagcccccucgagugccgcaccuucuuccugacccagggcgcccugcucaacgacaagcacuccaacgggaccaucaaggaccggagccccuaccgcacgcugauguccugcccgaucggcgaggugcccagccccuacaacucgcgguucgaguccgucgccuggagcgcguccgccugccacgacgggaucaacuggcugaccaucggcaucagcggccccgacuccggggccguggccgugcucaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccuggaguaccagaucggguacaucugcuccggcguguucggggacaacccgcggcccaacgacaagaccggcagcugcggccccgucuccagcaacggggccaacggcgugaagggguucagcuucaaguacggcaacgggguguggaucggccgcaccaaguccaucucgucccggaagggcuucgagaugaucugggaccccaacggguggaccggcaccgacaacaaguucagcaucaagcaggacgucguggggaucaacgagugguccggcuacagcggguccuucguccagcacccggagcucacgggccuggacugcauccgccccugcuucuggguggagcugauccggggccgccccgaggagaacaccaucuggaccagcggguccagcaucuccuucugcggcgugaacagcgacaccgucgggugguccuggcccgacggcgccgagcucccguucacgaucgacaaguga

SEQ ID NO: 28160 - RNA, 1410 nt, Artificial Sequence; identical to SEQ ID NO: 28127
  derived and/or modified CDS sequence (AUadapt) from InfluenzaA__AIM56295__NA

SEQ ID NO: 28161 - RNA, 1410 nt, Artificial Sequence; identical to SEQ ID NO: 28127
  derived and/or modified CDS sequence (AUadapt) from InfluenzaA__AIM56306__NA

SEQ ID NO: 28162 - RNA, 1410 nt, Artificial Sequence; identical to SEQ ID NO: 28127
  derived and/or modified CDS sequence (AUadapt) from InfluenzaA__AIM56317__NA

SEQ ID NO: 28163 - RNA, 1410 nt, Artificial Sequence; identical to SEQ ID NO: 28146
  derived and/or modified CDS sequence (AUadapt) from InfluenzaA__AIM56339__NA

SEQ ID NO: 28164 - RNA, 1410 nt, Artificial Sequence
  derived and/or modified CDS sequence (AUadapt) from InfluenzaA__AIM56350__NA
augaaccccaaccagaagaucaucaccaucggcucggugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugccggucaagcuggccgggaacucgucccucugccccgugagcggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacucgaacgggaccaucaaggaccgguccccguaccgcacgcugaugagcugccccaucggcgaggugcccucccccuacaacagccgguucgagagcgucgccugguccgcgagcgccugccacgacgggaucaacuggcucaccaucggcaucuccggcccggacucgggggccguggccgugcugaaguacaacggcaucaucaccgacaccaucaaguccuggcgcaacaacauccugcggacgcaggagagcgagugcgcgugcgucaacggguccugcuucaccaucaugaccgacggccccagcgacggccaggccuccuacaagaucuuccgcaucgagaaggggaagaucgugaaguccguggagaugaacgcccccaacuaccacuacgaggagugcuccugcuaccccgacagcuccgagaucacgugcgucugccgggacaacuggcacggcagcaaccgcccguggguguccuucaaccagaaccucgaguaccagaucggguacaucugcucgggcguguucggggacaacccccggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggacccgaacggguggaccggcaccgacaacaacuucuccaucaagcaggacaucgucgggaucaaggaguggucgggcuacuccgggagcuucgugcagcaccccgagcugacgggccuggacugcauccgccccugcuucugggucgagcucauccggggccgccccgaggagaacaccaucuggaccuccgggagcuccaucagcuucugcggcaucaacuccgacaccgugggguggagcuggccggacggcgccgagcugcccuucacgaucgacaaguga

SEQ ID NO: 28165 - RNA, 1410 nt, Artificial Sequence; identical to SEQ ID NO: 28156
  derived and/or modified CDS sequence (AUadapt) from InfluenzaA__AIM56361__NA

SEQ ID NO: 28166 - RNA, 1410 nt, Artificial Sequence; identical to SEQ ID NO: 28127
  derived and/or modified CDS sequence (AUadapt) from InfluenzaA__AIM56372__NA

SEQ ID NO: 28167 - RNA, 1410 nt, Artificial Sequence; identical to SEQ ID NO: 28156
  derived and/or modified CDS sequence (AUadapt) from InfluenzaA__AIM56383__NA

SEQ ID NO: 28168 - RNA, 1410 nt, Artificial Sequence
  derived and/or modified CDS sequence (AUadapt) from InfluenzaA__AIM56394__NA
augaaccccaaccagaagaucaucaccaucggcucggugugcaugaccaucgggauggccaaccugauccuccagaucggcaacaucaucuccaucugggucagccacuccauccagaucgggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccucgcugugcccgguguccggcugggccaucuacagcaaggacaacuccgugcgcaucggcagcaagggggacgucuucgugauccgggagcccuucaucuccugcagcccccucgagugccgcaccuucuuccugacccagggcgcccugcucaacgacaagcacuccaacgggaccaucaaggaccggagccccuaccgcacgcugauguccugcccgaucggcgaggugcccagccccuacaacucgcgguucgaguccgucgccuggagcgcguccgccugccacgacgggaucaacuggcugaccaucggcaucagcggccccgacuccggggccguggccgugcucaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccuggaguaccagaucggguacaucugcuccggcaucuucggggacaacccgcggcccaacgacaagaccggcagcugcggccccguguccagcaacggggccaacggcgucaagggguucagcuucaaguacggcaacgggguguggaucggccgcaccaaguccaucucgucccggaagggcuucgagaugaucugggaccccaacggguggaccggcaccgacaacaaguucagcaucaagcaggacaucguggggaucaacgagugguccggcuacagcggguccuucguccagcacccggagcucacgggccuggacugcauccgccccugcuucuggguggagcugauccggggccgccccgaggagaacaccaucuggaccagcggguccagcaucuccuucugcggcgucaacagcgacaccguggggugguccuggcccgacggcgccgagcucccguucacgaucgacaaguga

SEQ ID NO: 28169 - RNA, 1410 nt, Artificial Sequence; identical to SEQ ID NO: 28145
  derived and/or modified CDS sequence (AUadapt) from InfluenzaA__AIM56405__NA

SEQ ID NO: 28170 - RNA, 1410 nt, Artificial Sequence
  derived and/or modified CDS sequence (AUadapt) from InfluenzaA__AIM56416__NA
augaaccccaaccagaagaucaucaccaucggcucggugugcaugaccaucgggauggccaaccugauccuccagaucggcaacaucaucuccaucugggucagccacuccauccagcuggggaaccagagccacaucgagacgugcaaccaguccgugaucaccuacgagaacaacaccugggugaaccagaccuacgucaacaucagcaacaucaacuucgccgcgggccaguccguggugccggucaagcuggccgggaacucgucccucugccccgugagcggcugggccaucuacuccaaggacaacagcgugcgcaucggcuccaagggggacgucuucgugauccgggagcccuucaucagcugcagcccccuggagugccgcacguucuuccugacccagggcgcccuccugaacgacaagcacuccaacgggaccaucaaggaccgguccccguaccgcacccugaugucgugccccaucggcgaggugcccucccccuacaacagccgguucgagagcgucgccugguccgcgagcgccugccacgacgggaucaacuggcucacgaucggcaucuccggcccggacaacggggccguggccgugcugaaguacaacggcaucaucaccgacaccaucaagagcuggcgcaacaacauccugcggacccaggaguccgagugcgcgugcgucaacgggucgugcuucacgaucaugaccgacggccccuccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgcccgugggugucguucaaccagaaccucgaguaccagaucggguacaucugcuccggcguguucggggacaacccccggcccaacgacaagaccggcagcugcggccccgucaccuccaacggggccaacggcgugaagggguucagcuucaaguacggcaacgggguguggaucggccgcaccaaguccaucagcagccggaagggcuucgagaugaucugggacccgaacggguggaccggcaccgacaacaacuucuccaucaagcaggacaucgucgggaucaaggaguggucgggcuacuccgggagcuucgugcagcaccccgagcugacgggccuggacugcauccgccccugcuucugggucgagcucauccggggccgccccgaggagaacaccaucuggaccuccgggagcuccaucagcuucugcggcgugaacuccgacaccgugggguggagcuggccggacggcgccgagcugcccuucacgaucgacaaguga

SEQ ID NO: 28171 - RNA, 1410 nt, Artificial Sequence; identical to SEQ ID NO: 28145
  derived and/or modified CDS sequence (AUadapt) from InfluenzaA__AIM56428__NA

SEQ ID NO: 28172 - RNA, 1410 nt, Artificial Sequence; identical to SEQ ID NO: 28127
  derived and/or modified CDS sequence (AUadapt) from InfluenzaA__AIM56439__NA

SEQ ID NO: 28173 - RNA, 1410 nt, Artificial Sequence
  derived and/or modified CDS sequence (AUadapt) from InfluenzaA__AIM56450__NA
augaaccccaaccagaagaucaucaccaucggcucggugugcaugaccaucgggauggccaaccugauccuccagaucggcaacaucaucuccaucuggaucagccacuccauccaggucgggaaccagagccagaucgagacgugcaaccaguccgugaucaccuacgagaacaacaccugggugaaccagaccuacgucaacaucagcaacacgaacuucgccgcgggccagccggugguguccgucaagcuggccgggaacucgucccugugccccgugagcggcugggccaucuacuccaaggacaacagcgugcgcgucggcuccaagggggacguguucgugauccgggagcccuucaucagcugcagcccccucgagugccgcaccuucuuccugacccagggcgcccugcucaacgacaagcacucgaacgggaccaucaaggaccgguccccguaccgcacgcugaugagcugccccaucggcgagguccccucccccuacaacagccgguucgagagcguggccugguccgcgagcgccugccacgacgggaucaacuggcugaccaucggcaucuccggcccggacucgggggccguggccguccucaaguacaacggcaucaucaccgacaccaucaaguccuggcgcaacgacauccugcggacgcaggagagcgagugcgcgugcgugaacggguccugcuucaccaucaugaccgacggccccagcgacggccaggccuccuacaagaucuuccgcaucgagaaggggaagaucgugaaguccgucgagaugaacgcccccaacuaccacuacgaggagugcuccugcuaccccgacagcuccgagaucacgugcgugugccgggacaacuggcacggcagcaaccgcccguggguguccuucaaccagaaccuggaguacaagaucggguacaucugcucgggcaucuucggggacaacccccggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggacccgaacggguggaccggcaccgacaacaacuucuccgucaagcaggacaucguggggaucaacgaguggucgggcuacuccgggagcuucguccagcaccccgagcucacgggccuggacugcauccgccccugcuucuggguggagcugauccggggccgccccaaggagaacaccaucuggaccuccgggagcuccaucagcuucugcggcgugaacuccgacaccgucggguggagcuggccggacggcgccgagcuccccuucacgaucgacaaguga

SEQ ID NO: 28174 - RNA, 1410 nt, Artificial Sequence
  derived and/or modified CDS sequence (AUadapt) from InfluenzaA__AIM56461__NA
augaaccccaaccagaagaucaucaccaucggcucggugugcaugaccaucgggauggccaaccugauccuccagaucggcaacaucaucuccaucugggucagccacuccauccagaucgggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccucgcugugcccgguguccggcugggccaucuacagcaaggacaacuccgugcgcaucggcagcaagggggacgucuucgugauccgggagcccuucaucuccugcagcccccucgagugccgcaccuucuuccugacccagggcgcccugcucaacgacaagcacuccaacgggaccaucaaggaccggagccccuaccgcacgcugauguccugcccgaucggcgaggugcccagccccuacaacucgcgguucgaguccgucgccuggagcgcguccgccugccacgacgggaucaacuggcugaccaucggcaucagcggccccgacuccggggccguggccgugcucaaguacaacggcaucaucaccgacaccaucaagagcuggaagaacaacauccugcgcacgcaggaguccgagugcgcgugcgucaacgggagcugcuucaccaucaugaccgacggcccguccgacggccaggccagcuacaagaucuuccggaucgagaaggggaagaucgugaaguccguggagaugaacgcccccaacuaccacuacgaggagugcucgugcuaccccgacuccagcgagaucacgugcgucugccgcgacaacuggcacggcuccaaccggcccugggugagcuucaaccagaaccuggaguaccagaucggguacaucugcuccggcguguucggggacaacccgcgccccaacgacaagaccggcagcugcggccccgucuccagcaacggggccaacggcgugaagggguucagcuucaaguacggcaacgggguguggaucggccggaccaaguccaucucgucccgcaagggcuucgagaugaucugggaccccaacggguggaccggcaccgacaacaaguucagcaucaagcaggacaucgucggggugaacgagugguccggcuacagcggguccuucguccagcacccggagcucacgggccuggacugcauccggcccugcuucuggguggagcugauccgcggccggcccgaggagaacaccaucuggaccagcggguccagcaucuccuucugcggcgugaacagcgacaccgucgggugguccuggcccgacggcgccgagcucccguucacgaucgacaaguga

SEQ ID NO: 28175 - RNA, 1410 nt, Artificial Sequence
  derived and/or modified CDS sequence (AUadapt) from InfluenzaA__AIM56472__NA
augaaccccaaccagaagaucaucaccaucggcucggugugcaugaccaucgggauggccaaccugauccuccagaucggcaacaucaucuccaucugggucagccacuccauccagaucgggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccucgcugugcccgguguccggcugggccaucuacagcaaggacaacuccgugcgcaucggcagcaagggggacgucuucgugauccgggagcccuucaucuccugcagcccccucgagugccgcaccuucuuccugacccagggcgcccugcucaacgacaagcacuccaacgggaccaucaaggaccggagccccuaccgcacgcugauguccugcccgaucggcgaggugcccagccccuacaacucgcgguucgaguccgucgccuggagcgcguccgccugcaacgacgggaucaacuggcugaccaucggcaucagcggccccgacuccggggccguggccgugcucaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccuggaguaccagaucggguacaucugcuccggcguguucggggacaacccgcggcccaacgacaagaccggcagcugcggccccgucuccagcaacggggccaacggcgugaagggguucagcuucaaguacggcaacgggguguggaucggccgcaccaaguccaucucgucccggaagggcuucgagaugaucugggaccccaacggguggaccggcaccgacaacaaguucagcaucaagcaggacaucgucgggaucaacgagugguccggcuacagcggguccuucgugcagcacccggagcucacgggccuggacugcauccgccccugcuucugggucgagcugauccggggccgccccgaggagaacaccaucuggaccagcggguccagcaucuccuucugcggcgugaacagcgacaccguggggugguccuggcccgacggcgccgagcucccguucacgaucgacaaguga

SEQ ID NO: 28176 - RNA, 1410 nt, Artificial Sequence; identical to SEQ ID NO: 28133
  derived and/or modified CDS sequence (AUadapt) from InfluenzaA__AIM56483__NA

SEQ ID NO: 28177 - RNA, 1410 nt, Artificial Sequence; identical to SEQ ID NO: 28156
  derived and/or modified CDS sequence (AUadapt) from InfluenzaA__AIM56494__NA

SEQ ID NO: 28178 - RNA, 1410 nt, Artificial Sequence; identical to SEQ ID NO: 28146
  derived and/or modified CDS sequence (AUadapt) from InfluenzaA__AIM56505__NA

SEQ ID NO: 28179 - RNA, 1410 nt, Artificial Sequence; identical to SEQ ID NO: 28145
  derived and/or modified CDS sequence (AUadapt) from InfluenzaA__AIM56516__NA

SEQ ID NO: 28180 - RNA, 1410 nt, Artificial Sequence
  derived and/or modified CDS sequence (AUadapt) from InfluenzaA__AIM56527__NA
augaaccccaaccagaagaucaucaccaucggcucggugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcggagcaguccguggugucggucaagcuggccggcaacuccagccucugcccgguguccgggugggccaucuacagcaaggacaacuccgugcgcaucggcagcaagggcgacgucuucgugauccgggagcccuucaucuccugcagcccccuggagugccgcaccuucuuccugacccagggggcccuccugaacgacaagcacuccaacggcaccaucaaggaccggucgcccuaccgcacgcugauguccugcccgaucggggaggugcccagccccuacaacagccgguucgaguccgucgccuggagcgcguccgccugccacgacggcaucaacuggcucaccaucgggaucagcggccccgacuccggcgccguggccgugcugaaguacaacgggaucaucaccgacaccaucaagucguggcgcaacaacauccugcggacgcaggaguccgagugcgcgugcgucaacggcagcugcuucaccaucaugaccgacgggccguccgacggccaggccagcuacaagaucuuccgcaucgagaagggcaagaucgugaaguccguggagaugaacgcccccaacuaccacuacgaggagugcagcugcuaccccgacuccagcgagaucacgugcgucugccgggacaacuggcacggguccaaccgccccugggugucguucaaccagaaccucgaguaccagaucggcuacaucugcuccggggugcugggcgacaacccgcggcccaacgacaagaccgggagcugcggccccgucuccagcaacggcgccaacggggugaagggcuucagcuucaaguacgggaacggcguguggaucgggcgcaccaaguccaucagcucccggaagggcuucgagauggucugggaccccaacggcuggaccgggaccgacaacaacuucucgaucaagcaggacaucgugggcaucaaggagugguccggguacagcggcuccuucguccagcacccggagcugacggggcucgacugcauccgccccugcuucuggguggagcugauccggggccgccccgaggagaacaccaucuggaccagcggcuccagcaucuccuucugcggggugaacagcgacaccgucggcugguccuggcccgacggggccgagcugccguucacgaucgacaaguga

SEQ ID NO: 28181 - RNA, 1410 nt, Artificial Sequence; identical to SEQ ID NO: 28127
  derived and/or modified CDS sequence (AUadapt) from InfluenzaA__AIM56538__NA

SEQ ID NO: 28182 - RNA, 1410 nt, Artificial Sequence
  derived and/or modified CDS sequence (AUadapt) from InfluenzaA__AIM56549__NA
augaaccccaaccagaagaucaucaccaucggcucggugugcaugaccaucgggauggccaaccugauccuccagaucggcaacaucaucuccaucugggucagccacuccauccagaucgggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccucgcugugcccgguguccggcugggccaucuacagcaaggacaacuccgugcgcaucggcagcaagggggacgucuucgugauccgggagcccuucaucuccugcagcccccucgagugccgcaccuucuuccugacccagggcgcccugcucaacgacaagcacuccaacgggaccaucaaggaccggagccccuaccgcacgcugauguccugcccgaucggcgaggugcccagccccuacaacucgcgguucgaguccgucgccuggagcgcguccgccugccacgacgggaucaacuggcugaccaucggcaucagcggccccgacuccggggccguggccgugcucaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcucgugcuaccccgacuccagcgaggugaccugcgucugccgggacaacuggcacggcuccaaccgccccugggugagcuucaaccagaaccuggaguaccagaucggguacaucugcuccggcgucuucggggacaacccgcggcccaacgacaagacgggcagcugcggccccguguccagcaacggggccaacggcgugaagggguucagcuucaaguacggcaacggggucuggaucggccgcaccaaguccaucucgucccggaagggcuucgagaugaucugggaccccaacggguggaccggcaccgacaacaaguucagcaucaagcaggacaucguggggaucaacgagugguccggcuacagcggguccuucguccagcacccggagcucacgggccuggacugcauccgccccugcuucuggguggagcugauccggggccgccccgaggagaacaccaucuggaccagcggguccagcaucuccuucugcggcgugaacagcgacaccgucgggugguccuggcccgacggcgccgagcucccguucacgaucgacaaguga

SEQ ID NO: 28183 - RNA, 1410 nt, Artificial Sequence
  derived and/or modified CDS sequence (AUadapt) from InfluenzaA__AIM56560__NA
augaaccccaaccagaagaucaucaccaucggcucggugugcaugaccaucgggauggccaaccugauccuccagaucggcaacaucaucuccaucugggucagccacuccauccagcuggggaaccagagccacaucgagacgugcaaccaguccgugaucaccuacgagaacaacaccugggugaaccagaccuacgucaacaucucgaacacgaacuucgccgcgggccaguccguggugccggucaagcuggccgggaacagcucccucugccccgugagcggcugggccauccacuccaaggacaacagcgugcgcaucggcuccaagggggacgucuucgugauccgggagcccuucaucucgugcagcccccuggagugccgcaccuucuuccugacccagggcgcccuccugaacgacaagcacuccaacgggaccaucaaggaccgguccccguaccgcacgcugaugagcugccccaucggcgaggugcccucccccuacaacucgcgguucgagagcgucgccugguccgcgagcgccugccacgacgggaucaacuggcucaccaucggcaucuccggcccggacaacggggccguggccgugcugaaguacaacggcaucaucaccgacaccaucaagagcuggcgcaacaacauccugcggacgcaggaguccgagugcgcgugcgucaacgggucgugcuucaccaucaugaccgacggccccuccgacggccaggccagcuacaagaucuuccgcaucgagaaggggaagaucgugaaguccguggagaugaacgcccccaacuaccacuacgaggagugcagcugcuaccccgacuccucggagaucacgugcgucugccgggacaacuggcacggcuccaaccgcccgugggugagcuucaaccagaaccucgaguaccagaucggguacaucugcuccggcguguucggggacaacccccggcccaacgacaagaccggcagcugcggccccgucaccuccaacggggccaacggcgugaagggguucagcuucaaguacggcaacgggguguggaucggccgcaccaaguccaucucgagccggaagggcuucgagaugaucugggacccgaacggguggaccggcacggacaacaacuucuccaucaagcaggacaucgucgggaucaaggaguggagcggcuacuccgggucguucgugcagcaccccgagcugaccggccuggacugcauccgccccugcuucugggucgagcucauccggggccgccccgaggagaacaccaucuggaccuccgggagcuccaucagcuucugcggcgugaacuccgacacggugggguggagcuggccggacggcgccgagcugcccuucaccaucgacaaguga

SEQ ID NO: 28184 - RNA, 1410 nt, Artificial Sequence; identical to SEQ ID NO: 28133
  derived and/or modified CDS sequence (AUadapt) from InfluenzaA__AIM56571__NA

SEQ ID NO: 28185 - RNA, 1410 nt, Artificial Sequence
  derived and/or modified CDS sequence (AUadapt) from InfluenzaA__AIM56582__NA
augaaccccaaccagaagaucaucaccaucggcucggugugcaucaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccucgcucugcccgguguccggcugggccaucuacagcaaggacaacuccgugcgcaucggcagcaagggggacgucuucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacucgcgguucgaguccgucgccuggagcgcguccgccugccacgacgggaucaacuggcucaccaucggcaucagcggccccgacuccggggccguggccgugcugaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccucgaguaccagaucggguacaucugcuccggcguguucggggacaacccgcggcccaacgacaagaccggcagcugcggccccgucuccagcaacggggccaacggcgugaagggguucagcuucaaguacggcaacgggguguggaucggccgcaccaaguccaucucgucccggaagggcuucgagaugaucugggaccccaacggguggaccggcaccgacaacaacuucagcaucaagcaggacaucgucgggaucaaggagugguccggcuacagcggguccuucgugcagcacccggagcugacgggccuggacugcauccgccccugcuucugggucgagcucauccggggccgccccgaggagaacaccaucuggaccagcggguccagcaucuccuucugcggcgugaacagcgacaccguggggugguccuggcccgacggcgccgagcugccguucacgaucgacaaguga

SEQ ID NO: 28186 - RNA, 1410 nt, Artificial Sequence
  derived and/or modified CDS sequence (AUadapt) from InfluenzaA__AIM56593__NA
augaaccccaaccagaagaucaucaccaucggcucggugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcggagcaguccguggugucggucaagcuggccggcaacuccagccucugcccgguguccgggugggccaucuacagcaaggacaacuccgugcgcaucggcagcaagggcgacgucuucgugauccgggagcccuucaucuccugcagcccccuggagugccgcaccuucuuccugacccagggggcccuccugaacgacaagcacuccaacggcaccaucaaggaccggucgcccuaccgcacgcugauguccugcccgaucggggaggugcccagccccuacaacagccgguucgaguccgucgccuggagcgcguccgccugccacgacggcaucaacuggcucaccaucgggaucagcggccccgacuccggcgccguggccgugcugaaguacaacgggaucaucaccgacaccaucaagucguggcgcaacaacauccugcggacgcaggaguccgagugcgcgugcgucaacggcagcugcuucaccaucaugaccgacgggccguccgacggccaggccagcuacaagaucuuccgcaucgagaagggcaagaucgugaaguccguggagaugaacgcccccaacuaccacuacgaggagugcagcugcuaccccgacuccagcgagaucacgugcgucugccgggacaacuggcacggguccaaccgccccugggugucguucaaccagaaccucgaguaccagaucggcuacaucugcuccggggugcugggcgacaacccgcggcccaacgacaagaccgggagcugcggccccgucuccagcaacggcgccaacggggugaagggcuucagcuucaaguacgggaacggcguguggaucgggcgcaccaaguccaucagcucccggaagggcuucgagaugaucugggaccccaacggcuggaccgagaccgacaacaacuucucgaucaagcaggacaucgucgggaucaaggagugguccggcuacagcggguccuucgugcagcacccggagcugacgggccucgacugcauccgccccugcuucugggucgagcugauccgggggcgccccgaggagaacaccaucuggaccagcggcuccagcaucuccuucugcggcgugaacagcgacaccguggggugguccuggcccgacggcgccgagcugccguucacgaucgacaaguga

SEQ ID NO: 28187 - RNA, 1410 nt, Artificial Sequence
  derived and/or modified CDS sequence (AUadapt) from InfluenzaA__AIM56604__NA
augaaccccaaccagaagaucaucaccaucggcucggugugcaugaccaucgggauggccaaccugauccuccagaucggcaacaucaucuccaucugggucagccacuccauccagaucgggaaccagagccagaucgagacgugcaaccaguccgugaucaccuacgagaacaacaccugggugaaccagaccuacgucaacaucagcaacaucaacuucgccgcgggccaguccguggugagcgucaagcuggccgggaacuccagccugugcccgguguccggcugggccaucuacagcaaggacaacuccgugcgcaucggcucgaagggggacgucuucgugauccgggagcccuucaucuccugcagcccccucgagugccgcacguucuuccugacccagggcgcccugcucaacgacaagcacuccaacgggaccaucaaggaccggagccccuaccgcacccugauguccugcccgaucggcgaggugcccagccccuacaacagccgguucgaguccgucgccuggagcgcguccgccugccacgacgggaucaacuggcugacgaucggcaucagcggccccgacuccggggccguggccgugcucaaguacaacggcaucaucaccgacaccaucaagucguggcgcaacaacauccugcggacccaggaguccgagugcgcgugcgucaacgggagcugcuucacgaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccuggaguaccagaucggguacaucugcuccggcguguucggggacaacccgcggcccaacgacaagaccggcagcugcggccccgucuccucgaacggggccaacggcgugaagggguucagcuucaaguacggcaacgggguguggaucggccgcaccaaguccaucagcucccggaagggcuucgagaugaucugggaccccaacggguggaccggcaccgacaacaaguucagcaucaagcaggacaucgucgggaucaacgagugguccggcuacagcggguccuucgugcagcacccggagcucaccggccuggacugcauccgccccugcuucugggucgagcugauccggggccgccccgaggagaacacgaucuggaccagcggguccagcaucuccuucugcggcgugaacagcgacaccguggggugguccuggcccgacggcgccgagcucccguucaccaucgacaaguga

SEQ ID NO: 28188 - RNA, 1410 nt, Artificial Sequence
  derived and/or modified CDS sequence (AUadapt) from InfluenzaA__AIM56615__NA
augaaccccaaccagaagaucaucaccaucggcucggugugcaugaccaucgggauggccaaccugauccuccagaucggcaacaucaucuccaucugggucagccacuccauccagaucgggaaccagagccagaucgagacgugcaaccaguccgugaucaccuacgagaacaacaccugggugaaccagaccuacgucgacaucagcaacacgaacuucgccgcgggccaguccguggugagcgucaagcuggccgggaacuccagccugugcccgguguccggcugggccaucuacucgaaggacaacuccgugcgcaucggcagcaagggggacgucuucgugauccgggagcccuucaucuccugcagcccccucgagugccgcaccuucuuccugacccagggcgcccugcucaacgacaagcacuccaacgggaccaucaaggaccggagccccuaccgcacgcugauguccugcccgaucggcgaggugcccagccccuacaacagccgguucgaguccgucgccuggucggcguccgccugccacgacgggaucaacuggcugaccaucggcaucagcggccccgacuccggggccguggccgugcucaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccucggagaucacgugcgucugccgggacaacuggcacggcuccaaccgccccugggugagcuucaaccagaaccuggaguaccagaucggguacaucugcuccggcguguucggggacaacccgcggcccaacgacaagaccggcagcugcggccccgucuccagcaacggggccaacggcgugaagggguucagcuucaaguacuccaacggcguguggaucgggcgcaccaagagcaucuccucgcggaagggcuucgagaugaucugggaccccaacggcuggaccgggaccgacaacaaguucuccaucaagcaggacaucgucggcaucaacgaguggagcggguacuccggcagcuucgugcagcacccggagcucacggggcuggacugcauccgccccugcuucugggucgagcugauccggggccgccccgaggagaacaccaucuggaccuccggcagcuccaucagcuucugcggggugaacuccgacaccgugggcuggagcuggcccgacggggccgagcucccguucacgaucgacaaguga

SEQ ID NO: 28189 - RNA, 1410 nt, Artificial Sequence; identical to SEQ ID NO: 28182
  derived and/or modified CDS sequence (AUadapt) from InfluenzaA__AIM56626__NA

SEQ ID NO: 28190 - RNA, 1410 nt, Artificial Sequence; identical to SEQ ID NO: 28127
  derived and/or modified CDS sequence (AUadapt) from InfluenzaA__AIM56637__NA

SEQ ID NO: 28191 - RNA, 1410 nt, Artificial Sequence; identical to SEQ ID NO: 28133
  derived and/or modified CDS sequence (AUadapt) from InfluenzaA__AIM56648__NA

SEQ ID NO: 28192 - RNA, 1410 nt, Artificial Sequence
  derived and/or modified CDS sequence (AUadapt) from InfluenzaA__AIM56659__NA
augaaccccaaccagaagaucaucaccaucggcucggugugcaugaccaucgggauggccaaccugauccuccagaucggcaacaucaucuccaucugggucagccacuccauccagcuggggaaccagagccacaucgagacgugcaaccaguccgugaucaccuacgagaacaacaccugggugaaccagaccuacgucaacaucagcaacacgaacuucgccgcgggccaguccguggugccggucaagcuggccgggaacagcucccucugccccgugucgggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacagcaacgggaccaucaaggaccgguccccguaccgcacgcugaugagcugccccaucggcgaggugcccucccccuacaacucgcgguucgagagcgucgccugguccgcgagcgccugccacgacgggaucaacuggcucaccaucggcaucuccggcccggacagcggggccguggccgugcugaaguacaacggcaucaucaccgacaccaucaaguccuggcgcaacaacauccugcggacgcaggagagcgagugcgcgugcgucaacggguccugcuucaccaucaugaccgacggccccagcgacggccaggccuccuacaagaucuuccgcaucgagaaggggaagaucgugaaguccguggagaugaacgcccccaacuaccacuacgaggagugcuccugcuaccccgacucguccgagaucacgugcgucugccgggacaacuggcacggcagcaaccgcccguggguguccuucaaccagaaccucgaguaccagaucggguacaucugcagcggcguguucggggacaacccccggcccaacgacaagaucggcuccugcggccccgucagcuccaacggggccaacggcgugaagggguucagcuucaaguacggcaacgggguguggaucggccgcaccaagagcaucuccucgcggaagggcuucgagaugaucugggacccgaacggguggaccggcaccgacaacaacuucuccaucaagcaggacaucgucgggaucaaggaguggagcggcuacuccgggagcuucgugcagcaccccgagcugaccggccuggacugcauccgccccugcuucugggucgagcucauccggggccgccccgaggagaagacgaucuggaccuccgggagcuccaucagcuucugcggcgugaacuccgacaccgugggguggagcuggccggacggcgccgagcugcccuucaccaucgacaaguga

SEQ ID NO: 28193 - RNA, 1410 nt, Artificial Sequence
  derived and/or modified CDS sequence (AUadapt) from InfluenzaA__AIM56670__NA
augaaccccaaccagaagaucaucaccaucggcucggugugcaugaccaucgggauggccaaccugauccuccagaucggcaacacgaucuccaucugggucagccacuccauccagaucgggaaccagagccagaucgagaccugcaaccaguccgugaucaccuacgagaacaacaccugggugaaccagacguacgucaacaucagcaacaccaacuucgccgcgggccaguccguggugucggucaagcuggccgggaacuccagccugugcccgguguccggcugggccaucuacagcaaggacaacuccgugcgcaucggcagcaagggggacgucuucgugauccgggagcccuucaucuccugcagcccccucgagugccgcaccuucuuccugacccagggcgcccugcucaacgacaagcacuccaacgggacgaucaaggaccggucgcccuaccgcacccugauguccugcccgaucggcgaggugcccagccccuacaacagccgguucgaguccgucgccuggagcgcguccgccugccacgacgggaucaacuggcugaccaucggcaucagcggccccgacuccggggccguggccgugcucaaguacaacggcaucaucaccgacacgaucaagucguggcgcaacaacauccugcggacccaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccuggaguaccagaucggguacaucugcuccggcguguucggggacaacccgcggcccaacgacaagaccggcagcugcggccccgucuccagcaacggggccaacggcgugaagggguucagcuucaaguacggcaacgggguguggaucggccgcaccaaguccaucagcucccggaagggcuucgagaugaucugggaccccaacggguggaccggcacggacaacaaguucucgaucaagcaggacaucgucgggaucaacgagugguccggcuacagcggguccuucgugcagcacccggagcucaccggccuggacugcauccgccccugcuucugggucgagcugauccggggccgccccgaggagaacaccaucuggaccagcggguccagcaucuccuucugcggcgugaacagcgacacgguggggugguccuggcccgacggcgccgagcucccguucaccaucgacaaguga

SEQ ID NO: 28194 - RNA, 1410 nt, Artificial Sequence; identical to SEQ ID NO: 28145
  derived and/or modified CDS sequence (AUadapt) from InfluenzaA__AIM56703__NA

SEQ ID NO: 28195 - RNA, 1410 nt, Artificial Sequence
  derived and/or modified CDS sequence (AUadapt) from InfluenzaA__AIM56714__NA
augaaccccaaccagaagaucaucaccaucggcucggugugcaugaccaucgggauggccaaccugauccuccagaucggcaacaucaucuccaucugggucagccacuccauccagaucgggaaccagagccagaucgagacgugcaaccaguccgugaucaccuacgagaacaacaccugggugaaccagaccuacgucaacaucagcaacacgaacuucgccgcgggccaguccguggugucggucaagcuggccgggaacuccagccugugcccgguguccggcugggccaucuacagcaaggacaacuccgugcgcaucggcagcaagggggacgucuucgugauccgggagcccuucaucuccugcagcccccucgagugccgcaccuucuuccugacccagggcgcccugcucaacgacaagcacuccaacgggaccaucaaggaccggucgcccuaccgcacgcugauguccugcccgaucggcgaggugcccagccccuacaacagccgguucgaguccgucgccuggagcgcguccgccugccacgacgggaucaacuggcugaccaucggcaucagcggccccgacuccggggccguggccgugcucaaguacaacggcaucaucaccgacaccaucaagucguggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccuggaguaccagaucggguacaucugcuccggcguguucggggacaacccgcggcccaacgacaagaccggcagcugcggccccguccccuccaacggggccaacggcgugaagggguucagcuucaaguacggcaacgggguguggaucggccgcaccaagagcaucuccagccggaagggcuucgagaugaucugggacccgaacggguggaccggcaccgacaacaaguucuccaucaagcaggacaucgucgggaucaacgaguggucgggcuacuccgggagcuucgugcagcaccccgagcucacgggccuggacugcauccgccccugcuucugggucgagcugauccggggccgccccgaggagaacaccaucuggaccuccgggagcuccaucagcuucugcggcgugaacuccgacaccgugggguggagcuggccggacggcgccgagcuccccuucacgaucgacaaguga

SEQ ID NO: 28196 - RNA, 1410 nt, Artificial Sequence
  derived and/or modified CDS sequence (AUadapt) from InfluenzaA__AIM56725__NA
augaaccccaaccagaagaucaucaccaucggcucggugugcaugaccaucgggauggccaaccugauccuccagaucggcaacaucaucuccaucugggucagccacuccauccagaucgggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccucgcugugcccgguguccggcugggccaucuacagcaaggacaacuccgugcgcaucggcagcaagggggacgucuucgugauccgggagcccuucaucuccugcagcccccucgagugccgcaccuucuuccugacccagggcgcccugcucaacgacaagcacuccaacgggaccaucaaggaccggagccccuaccgcacgcugauguccugcccgaucggcgaggugcccagccccuacaacucgcgguucgaguccgucgccuggagcgcguccgccugccacgacgggaucaacuggcugaccaucggcaucagcggccccgacuccggggccguggccgugcucaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcucgugcuaccccgacuccagcgaggugaccugcgucugccgggacaacuggcacggcuccaaccgccccugggugagcuucaaccagaaccuggaguaccagaucggguacaucugcuccggcaucuucggggacaacccgcggcccaacgacaagacgggcagcugcggccccgucuccagcaacggggccaacggcgugaagggguucagcuucaaguacggcaacgggguguggaucggccgcaccaaguccaucucgucccggaagggcuucgagaugaucugggaccccaacggguggaccggcaccgacaacaaguucagcaucaagcaggacaucgucgggaucaacgagugguccggcuacagcggguccuucgugcagcacccggagcucacgggccuggacugcauccgccccugcuucugggucgagcugauccggggccgccccgaggagaacaccaucuggaccagcggguccagcaucuccuucugcggcgugaacagcgacaccguggggugguccuggcccgacggcgccgagcucccguucacgaucgacaaguga

SEQ ID NO: 28197 - RNA, 1410 nt, Artificial Sequence; identical to SEQ ID NO: 28145
  derived and/or modified CDS sequence (AUadapt) from InfluenzaA__AIM56736__NA

SEQ ID NO: 28198 - RNA, 1410 nt, Artificial Sequence
  derived and/or modified CDS sequence (AUadapt) from InfluenzaA__AIM56747__NA
augaaccccaaccagaagaucaucaccaucggcucggugugcaugaccaucgggauggccaaccugauccuccagaucggcaacaucaucuccaucugggucagccacuccauccagaucgggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccagccugugcccgguguccggcugggccaucuacucgaaggacaacuccgugcgcaucggcagcaagggggacgucuucgugauccgggagcccuucaucuccugcagcucccucgagugccgcaccuucuuccugacccagggcgcccugcucaacgacaagcacagcaacgggaccaucaaggaccggucccccuaccgcacgcugaugagcugccccaucggcgaggugccgagccccuacaacucccgguucgagucggucgccugguccgcgagcgccugccacgacgggaucaacuggcugaccaucggcaucuccggccccgacagcggggccguggccgugcucaaguacaacggcaucaucaccgacaccaucaaguccuggcgcaacaacauccugcggacgcaggagagcgagugcgcgugcgucaacggguccugcuucaccaucaugaccgacggccccagcgacggccaggccuccuacaagaucuuccgcaucgagaaggggaagaucgucaagagcguggagaugaacgccccgaacuaccacuacgaggagugcuccugcuaccccgacucguccgagaucacgugcgugugccgggacaacuggcacggcagcaaccgccccuggguguccuucaaccagaaccuggaguaccagaucggguacaucugcagcggcguguucggggacaacccccggccgaacgacaagaccggcuccugcggccccgucagcagcaacggggccaacggcgugaagggguucuccuucaaguacggcaacgggguguggaucggccgcaccaagagcaucuccucgcggaagggcuucgagaugaucugggaccccaacggguggaccggcaccgacaacaaguucuccaucaagcaggacaucgucgggaucaacgaguggagcggcuacuccgggagcuucgugcagcaccccgagcucacgggccuggacugcauccgcccgugcuucugggucgagcugauccggggccgccccgaggagaacaccaucuggaccuccgggagcuccaucagcuucugcggcgugaacuccgacaccgugggguggagcuggcccgacggcgccgagcuccccuucacgaucgacaaguga

SEQ ID NO: 28199 - RNA, 1410 nt, Artificial Sequence; identical to SEQ ID NO: 28182
  derived and/or modified CDS sequence (AUadapt) from InfluenzaA__AIM56758__NA

SEQ ID NO: 28200 - RNA, 1410 nt, Artificial Sequence; identical to SEQ ID NO: 28145
  derived and/or modified CDS sequence (AUadapt) from InfluenzaA__AIM56769__NA

SEQ ID NO: 28201 - RNA, 1410 nt, Artificial Sequence
  derived and/or modified CDS sequence (AUadapt) from InfluenzaA__AIM56780__NA
augaaccccaaccagaagaucaucaccaucggcucggugugcaugaccaucgggauggccaaccugauccuccagaucggcaacaucaucuccaucugggucagccacuccauccagcuggggaaccagagccagaucggcacgugcaaccaguccgugaucaccuacgagaacaacaccugggugaaccagaccuacgucaacaucagcaacacgaacuucgccgcggggcaguccguggugagcgucaagcuggccggcaacuccucgcucugcccgguguccggcugggccaucuacagcaaggacaacuccgugcgcaucgggagcaagggcgacgucuucgugauccgggagcccuucaucuccugcagcccccuggagugccgcaccuucuuccugacccagggggcccuccugaacgacaagcacuccaacggcaccaucaaggaccggagccccuaccgcacgcugauguccugcccgaucggggaggugcccagccccuacaacucgcgguucgaguccgucgccuggagcgcguccgccugccacgacggcaucaacuggcucaccaucggcaucagcgggcccgacuccggcgccguggccgugcugaaguacaacgggaucaucaccgacaccaucaagagcuggcgcaacaacauccugcggacgcaggaguccgagugcgcgugcgucaacggcagcugcuucaccaucaugaccgacggcccguccgacgggcaggccagcuacaagaucuuccgcaucgagaagggcaagaucaucaaguccguggagaugaacgcccccaacuaccacuacgaggagugcucgugcuaccccgacuccagcgagaucacgugcgugugccgggacaacuggcacggguccaaccgccccugggucagcuucaaccagaaccucgaguaccagaucggcuacaucugcuccgggguguucggcgacaacccgcggcccaacgacaagaccggcagcugcgggcccguguccagcaacggcgccaacggggucaagggcuucagcuucaaguacgggaacggcguguggaucggccgcaccaaguccaucucgucccggaagggguucgagaugaucugggaccccaacggcuggaccgggaccgacaacaaguucagcaucaagcaggacaucgugggcauccacgagugguccggguacagcggcuccuucguccagcacccggagcugacgggccuggacugcauccgccccugcuucuggguggagcucauccgggggcgccccgaggagaacaccaucuggaccagcggcuccagcaucuccuucugcggggucaacagcgacaccgugggcugguccuggcccgacggcgccgagcugccguucacgaucgacaaguga

SEQ ID NO: 28202 - RNA, 1410 nt, Artificial Sequence
  derived and/or modified CDS sequence (AUadapt) from InfluenzaA__AIM56791__NA
augaaccccaaccagaagaucaucaccaucggcucggugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccagccucugcccgguguccggcugggccaucuacucgaaggacaacuccgugcgcaucggcagcaagggggacgucuucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccgucgccuggucggcguccgccugccacgacgggaucagcuggcucaccaucggcaucuccggccccgacagcggggccguggccgugcugaaguacaacggcaucaucaccgacaccaucaaguccuggcgcaacaacauccugcggacgcaggagagcgagugcgcgugcgucaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccuggguguccuucaaccagaaccucgaguaccagaucggguacaucugcagcggcguguucggggacaacccgcggcccaacgacaagaccggcuccugcggccccgucagcagcaacggggccaacggcgugaagggguucuccuucaaguacggcaacgggguguggaucggccgcaccaagagcaucuccucgcggaagggcuucgagaugaucugggaccccaacggguggaccggcaccgacaacaacuucuccaucaagcaggacaucgucgggaucaaggaguggagcggcuacuccgggagcuucgugcagcacccggagcugacgggccuggacugcauccgccccugcuucugggucgagcucauccggggccgccccgaggagaacaccaucuggaccuccgggagcuccaucagcuucugcggcgugaacuccgacaccgugggguggagcuggcccgacggcgccgagcugccguucacgaucgacaaguga

SEQ ID NO: 28203 - RNA, 1410 nt, Artificial Sequence
  derived and/or modified CDS sequence (AUadapt) from InfluenzaA__AIM56813__NA
augaaccccaaccagaagaucaucaccaucggcucggugugcaugaccaucgggauggccaaccugauccuccagaucggcaacaucaucuccaucugggucagccacuccauccagaucgggaaccagagccagaucgagacgugcaaccaguccgugaucaccuacgagaacaacaccugggugaaccagaccuacgucaacaucagcaacacgaacuucgccgcgggccaguccguggugucggucaagcuggccgggaacuccagccugugcccgguguccggcugggccaucuacagcaaggacaacuccgugcgcaucggcagcaagggggacgucuucgugauccgggagcccuucaucuccugcagcccccucgagugccgcaccuucuuccugacccagggcgcccugcucaacgacaagcacuccaacgggaccaucaaggaccggucgcccuaccgcacgcugauguccugcccgaucggcgaggugcccagccccuacaacagcaaguucgaguccgucgccuggagcgcguccgccugccacgacgggaucaacuggcugaccaucggcaucagcggccccgacaacggggccguggccgugcucaaguacaacggcaucaucaccgacaccaucaaguccuggcggaacaacauccugcgcacgcaggagucggagugcgcgugcgucaacggguccugcuucaccaucaugaccgacggcccgagcgacggccaggccuccuacaagaucuuccggaucgagaaggggaagaucgucaagagcguggagaugaacgcccccaacuaccacuacgaggagugcuccugcuaccccgacagcuccgagaucacgugcgugugccgcgacaacuggcacggcagcaaccggcccuggguguccuucaaccagaaccuggaguaccagaucggguacaucugcucgggcguguucggggacaacccgcgccccaacgacaagaccggcuccugcggccccgucagcuccaacggggccaacggcgugaagggguucagcuucaaguacggcaacgggguguggaucggccggaccaagagcaucuccagccgcaagggcuucgagaugaucugggaccccaacggguggaccggcaccgacaacaaguucuccaucaagcaggacaucgucgggaucaacgaguggucgggcuacuccgggagcuucgugcagcacccggagcucacgggccuggacugcauccggcccugcuucugggucgagcugauccgcggccggcccgaggagaacaccaucuggaccuccgggagcuccaucagcuucugcggcgugaacuccgacaccgugggguggagcuggcccgacggcgccgagcucccguucacgaucgacaaguga

SEQ ID NO: 28204 - RNA, 1410 nt, Artificial Sequence
  derived and/or modified CDS sequence (AUadapt) from InfluenzaA__AIM56824__NA
augaaccccaaccagaagaucaucaccaucggcucggugugcaugaccaucgggauggccaaccugauccuccagaucggcaacaucaucuccaucugggucagccacuccauccagaucgggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccucgcugugcccgguguccggcugggccaucuacagcaaggacaacuccgugcgcaucggcagcaagggggacgucuucgugauccgggagcccuucaucuccugcagcccccucgagugccgcaccuucuuccugacccagggcgcccugcucaacgacaagcacuccaacgggaccaucaaggaccggagccccuaccgcacgcugauguccugcccgaucggcgaggugcccagccccuacaacucgcgguucgaguccgucgccuggagcgcguccgccugccacgacgggaucaacuggcugaccaucggcaucagcggccccgacuccggggccguggccgugcucaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccuggaguaccagaucggguacaucugcuccggcguguucggggacaacccgcggcccaacgacaagaccggcagcugcggccccguccccuccaacggggccaacggcgugaagggguucagcuucaaguacagcaacggcguguggaucgggcgcaccaaguccaucucgucccggaagggcuucgagaugaucugggacccgaacggcuggaccgggaccgacaacaaguucagcaucaagcaggacaucgucggcaucaacgagugguccggguacagcggcuccuucgugcagcaccccgagcucacggggcuggacugcauccgccccugcuucugggucgagcugauccggggccgccccgaggagaacaccaucuggaccagcggcuccagcaucuccuucugcggggugaacagcgacaccgugggcugguccuggccggacggggccgagcuccccuucacgaucgacaaguga

SEQ ID NO: 28205 - RNA, 1398 nt, Artificial Sequence
  derived and/or modified CDS sequence (AUadapt) from InfluenzaA__AIN76385__NA
augaaucccaaccagaagauccugugcaccucggccaccgccaucaucaucggcgcgaucgccgugcucaucgggaucgccaaccugggccugaacaucgggcuccaccugaagccgggcugcaacugcucccacucgcagcccgggacgaccaacaccucccagaccaucaucaacaacuacuacaaugagacgaacaucaccaacauccagauggaggagcgcaccucgcggaacuucaacucccugaccaagggccucugcacgaucaacucguggcacaucuacggcaaggacaacgccguccgcaucggggaguccucggacgugcuggugacccgggagcccuacgucuccugcgaucccgacgagugccgcuucuacgcccugucgcagggcaccaccauccgggggaagcacuccaacggcacgauccacgaccgcucgcaguaccgggcgcucaucuccuggccgcugucguccccgcccaccguguacaacucgcgcguggagugcaucgggugguccaguaccuccugccacgacggcaagucgcggaugucgaucugcaucuccggccccaacaacaacgccucggccgucgugugguacaaccgccggcccguggccgagaucaacaccugggcgcgcaacauccugcggacgcaggaguccgagugcgucugccacaaugggaucugccccaucguguucaccgacggcucggccaccgggcccgccgacacccgcaucuacuacuucaaggagggcaagauccucaagugggagucccugacgggcaccgccaagcacaucgaggagugcucgugcuacggggagcggaccggcaucacgugcacgugcaaggacaacuggcagggguccaaucgccccgugauccagaucgacccggucgccaugacccacaccucgcaguacaucugcucccccgugcugaccgacacgccccggcccaacgacccgaacaucggcaagugcaacgaccccuaccccgggaacaacaacaauggcgugaagggcuucucguaccucgacggggcgaacaccuggcugggccgcaccaucuccaccgccucgcgguccggguacgagaugcugaagguccccaacgcccucaccgacgaccgcucgaagccgauccagggccagaccaucgugcugaacgccgacugguccggguacucgggcuccuucauggacuauugggccgagggcgacugcuaccgggcgugcuucuacguggagcugauccgcgggcgccccaaggaggacaaggucugguggaccucgaacuccaucgugucgaugugcucguccaccgaguuccucggccaguggaacuggcccgacggggcccggaucgaguacuuccuguga

SEQ ID NO: 28206 - RNA, 1410 nt, Artificial Sequence; identical to SEQ ID NO: 16489
  derived and/or modified CDS sequence (AUadapt) from InfluenzaA__AIP93105__NA

SEQ ID NO: 28207 - RNA, 1410 nt, Artificial Sequence
  derived and/or modified CDS sequence (AUadapt) from InfluenzaA__AIP93117__NA
augaaccccaaccagaagaucaucaccaucggcucggugucccugaccaucgccacggucugcuuccucaugcagaucgccauccuggcgaccaccgugacccugcacuucaagcagcacgagugcgacucgccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacucgauccgccuguccgccggcggggacaucugggucacgcgggagcccuacgugucgugcgaccccggcaagugcuaccaguucgcccuggggcagggcaccacccucgacaacaagcacuccaacggcaccauccacgaccgcaucccgcaccggacgcugcugaugaacgagcucggggugcccuuccaccugggcaccaagcaggucugcguggcguggagcuccucguccugccacgacgggaaggccuggcugcacgugugcgucaccggcgacgaccgcaacgccaccgccucguucaucuacgacgggcggcucguggacuccaucggcagcuggucccagaacauccugcgcacgcaggagucggagugcgugugcaucaacgggaccugcaccgucgugaugaccgacggcuccgcgucgggccgggccgacacgcgcauccuguucaucaaggaggggaagaucgugcacaucagcccccucuccggcucggcccagcacaucgaggagugcuccugcuacccccgguacccggacguccgcugcaucugccgggacaacuggaagggcagcaaccgccccgugaucgacaucaacauggaggacuacuccaucgacucguccuacgugugcucggggcuggucggcgacacgccccggaacgacgacuccagcuccaacucgaacugccgcgaccccaacaacgagcgggggaacccgggcgugaaggggugggccuucgacaacggcgacgacguguggaugggccgcaccaucuccaaggaccugcggucgggguacgagaccuucaaggucaucggcgggugguccacccccaacagcaagucccaggugaaccgccaggucaucguggacaacaacaacuggucgggcuacuccgggaucuucucgguggagggcaagagcugcaucaaccggugcuucuacgucgagcucauccgcggccgcccccaggagacccgggugugguggaccuccaacucgaucguggucuucugcgggaccuccggcacguacgggaccggcagcuggcccgacggggccaacaucaacuucaugccgaucuga

SEQ ID NO: 28208 - RNA, 1410 nt, Artificial Sequence
  derived and/or modified CDS sequence (AUadapt) from InfluenzaA__AIR93973__NA
augaaccccaaccagaagaucaucaccaucggcucggugugcaugaccaucgggauggccaaccugauccuccagaucggcaacaucaucuccaucuggaucagccacuccauccagcuggggagccgcaaccagaucgaggccugcaaccaguccgucaucacguacgagaacaacaccugggugaaccagaccuacgugaacaucagcaacaccaacuucgcggccggccaguccgucgugccggugaagcuggccgggaacagcucccucugccccgucucgggcugggccaucuacuccaaggacaacagcauccggaucggcuccaagggggacguguucgugauccgcgagcccuucaucagcugcagcccccuggagugccggacguucuuccugacccagggcgcccuccugaacgacaagcacuccaacgggaccaucaaggaccgcuccccguaccggacccugaugagcugccccaucggcgagguccccucccccuacaacagccgcuucgagucgguggcgugguccgccagcgccugccacgacgggaucaacuggcucacgaucggcaucuccggcccggacaacggggccguggcgguccugaaguacaacggcaucaucaccgacaccaucaagagcuggcggaacaacauccugcgcacccaggaguccgagugcgugugcgugaacgggagcugcuucacggucaugaccgacggccccuccaacggccaggccagcuacaagaucuuccggaucgagaaggggaagaucgugaaguccguggagaugaacgcccccaacuaccacuacgaggagugcucgugcuaccccgacuccagcgagaucacgugcgucugccgcgacaacuggcacggcuccaaccggccgugggugagcuucaaccagaaccucgaguaccagaucggguacaucugcuccggcaucuucggggacaacccccgccccaacgacaagaccggcagcugcggccccguguccagcaacggggccaacggcgucaagggguucuccuucaaguacggcaacgggguguggaucggccggaccaagagcaucucgucccgcaacggcuucgagaugaucugggacccgaacggguggaccgagaccgacaacaacuucagcaucaagcaggacaucgugggcaucaacgagugguccggguacagcggcuccuucguccagcaccccgagcugaccgggcuggacugcauccggcccugcuucuggguggagcucauccgcggccggcccaaggagaacacgaucuggaccagcggcuccagcaucuccuucugcggggucaacagcaacaccgugggcugguccuggccggacggggccgagcugcccuucaccaucgacaaguga

SEQ ID NO: 28209 - RNA, 1410 nt, Artificial Sequence
  derived and/or modified CDS sequence (AUadapt) from InfluenzaA__AIR93984__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccaacggccaggccagcuacaagaucuuccgcaucgagaaggggaagaucgucaaguccguggagaucaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccugggcugcauccgccccugcuucugggucgagcucauccgggggcgccccaaggagaacaccaucuggaccagcggcuccagcaucuccuucugcggggugaacagcgacaccgucggcugguccuggcccgacggcgccgagcugccguucacgaucgacaaguga

SEQ ID NO: 28210 - RNA, 1410 nt, Artificial Sequence
  derived and/or modified CDS sequence (AUadapt) from InfluenzaA__AIR93995__NA
augaaccccaaccagaagaucaucaucaucggcucggugugcaugaccaucgggauggccaaccugauccuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagagcgucgugccggugaagcuggccgggaacuccagccucugccccgucuccggcugggccaucuacucgaaggacaacuccauccgcaucggcagcaagggggacguguucgugauccgggagcccuucaucuccugcagcccccuggagugccgcacguucuuccugacccagggcgcccuccugaacgacaagcacuccaacgggaccaucaaggaccggagcccguaccgcacccugauguccugccccaucggcgagguccccagccccuacaacucccgguucgagagcguggccuggucggcguccgccugccacgacgggaucaacuggcucacgaucggcaucagcggcccggacaacggggccguggccguccugaaguacaacggcaucaucaccgacaccaucaaguccuggaagaacaacauccugcgcacccaggagagcgagugcgugugcgugaacggguccugcuucacggucaugaccgacggccccagcaacggccaggcguccuacaagaucuuccggaucgagaaggggaagaucgucaagagcguggagaugaacgcccccaacuaccacuacgaggagugcuccugcuaccccgacucguccgagaucacgugcgugugccgcgacaacuggcacggcagcaaccggccguggguguccuucaaccagaaccucgaguaccagaucggguacaucugcagcggcguguucggggacaacccccgccccaacgacaagaccggcuccugcggccccgucagcuccaacggggccaacggcgugaagggguucagcuucaaguacggcaacgggguguggaucggccggaccaaguccaucagcucgcgcaacggcuucgagaugaucugggacccgaacggguggaccggcaccgacaacaacuucuccaucaagcaggacaucaucgggaucaacgaguggagcggcuacuccgggagcuucguccagcaccccgagcugaccggcauggacugcauccggcccugcuucuggguggagcugauccgcggccggcccaaggagaacacgaucuggaccuccgggagcuccaucagcuucugcggcgucaacuccgacaccgugggguggagcuggccggacggcgccgagcuccccuucaccaucgacaaguga

SEQ ID NO: 28211 - RNA, 1401 nt, Artificial Sequence
  derived and/or modified CDS sequence (AUadapt) from InfluenzaA__AIR94118__NA
augaaccccaaccagaagaucaucgccaucggcucggugucccugaucaucgccaucaucugccuccugaugcagaucgcgauccugaccaccacgaugacccuccacuuccgccagaacgagugcaacaacucguccaacaaccaggucaugccgugcgagcccaucaucaucgagcggaacaccgugcaccugaacagcaccacgaucgagcgcgagaucugccccaagguggccgaguacaagaacugguccaagccccagugccagaucaccggguucgccccguucucgaaggacaacuccauccggcugucggccggcggggacaucugggucacccgcgagcccuacguguccugcagccucgacaagugcuaccaguucgcccugggccaggggaccacgcugaagaacaagcacuccaacggcaccacccacgaccggacgccccaccgcacccuccugaugaacgagcugggcgugcccuuccaccucgggaccaagcaggucugcaucgcguggucguccagcuccugcuacgacggcaaggccuggcugcacaucugcgugaccggggacgacaagaacgccaccgccucgaucaucuacaacggcaugcugguggacuccaucgggucgugguccaagaacauccuccggacgcaggagagcgagugcgucugcaucaacgggaccugcgcgguggugaugaccgacggcucggccuccggcaaggccgacacccgcguccuguucaucaaggagggcaagaucaucaacaucagcccgcuguccgggucggcccagcacguggaggagugcuccugcuacccccgguaccccgaggugcgcugcgucugccgggacaacuggaagggcucgaaccgccccauccucuacaucaacauggccgacuacuccaucgagagcuccuacgugugcucgggccuggugggggacacgccgcggaacgacgacuccucguccagcuccaacugcaaggaccccaacucggagcgcggcgcgcccggggucaagggcugggccuucgacgacgggaacgacguguggaugggccggaccaucaagaacggcucccgcagcggguacgagaccuuccggguggucaacggcuggaccguggccaacuccaagucgcaggugaaccgccaggucaucguggacucggacgacugguccggguacagcggcaucuucuccgucgaggggaagaagugcaucaaccggugcuucuacguggagcugauccgcggccggccccaggagccgcgcgugugguggacgucgaacuccaucaucgucuucugcggcaccagcgggaccuacggcaccggguccuggcccgacggcgccaacaucaacuucaugcccaucuga

SEQ ID NO: 28212 - RNA, 1410 nt, Artificial Sequence
  derived and/or modified CDS sequence (AUadapt) from InfluenzaA__AIT38335__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccacgaaccaggugaugcucugcgagcccaccaucaucgagcgcaacaucaccgagaucgucuaccugaccaacacgaccaucgagaaggagaucugccccaagcugguggaguaccggaacugguccaagccgcagugcaagaucaccggguucgcgcccuucagcaaggacaacuccauccgccucucggccggcggggacaucugggugacccgggagcccuacgucuccugcgaccccgacaagugcuaccaguucgcccugggccaggggacgacccugaacaaccgccacagcaacgacaccgugcacgaccggaccccguaccgcacgcuccugaugaacgagcugggcauccccuuccaccucggcaccaagcaggucugcaucgccugguccucguccagcugccacgacgggaaggccuggcugcacgugugcgugaccggccacgacgagaacgcgaccgccuccuucaucuacgacgggcggcugguggacucgaucgucuccuggagcaagcgcauccuccggacgcaggaguccgagugcgugugcaucgacgggaccugcaccguggucaugaccgacgggucggccuccggccgcgccgacacgcggauccuguucaucaaggagggcaagaucauccacaucagccagcugucgggguccgcgcagcacguggaggagugcagcugcuacccccgcuaccccggcgugcggugcgucugccgcgacaacuggaagggguccaaccggccgaucguggacaucaacgugaaggacuacucgaucaacuccagcuacgucugcuccggccucgugggcgacacgccccgcaagaacgacucguucuccagcuccuacugccugaaccccaacaacgaggagggcggccacggggugaagggcugggccuucgacgacggggacgacgucuggaugggccggaccaucaacgagaagcugcgcucgggcuacgagaccuucaaggugaucaaggggugguccaagcccaacagcaagcuccagaucaaccggcaggucaucguggaccgcggcaaccgguccggguacucgggcaucuucuccguggaggggaagggcugcaucaaccgcugcuucuacgucgagcugauccgcggccggaagcaggagaccgaggugugguggaccagcaacuccaucguggucuucugcgggaccucgggcaccuacgggacgggcagcuggccggacggggccaacaucaaccugaugcccaucuga

SEQ ID NO: 28213 - RNA, 1410 nt, Artificial Sequence
  derived and/or modified CDS sequence (AUadapt) from InfluenzaA__AIT38346__NA
augaaccccaaccagaagaucaucaccaucggcucgaucucccugaccaucgccacgaucugcuuccuccuccagguggccauccuggucaccaccgugacccugcacuucaagcaguucgagugcaacccgacgcccaacaaccaggugaugcugugcgagcccaccgucaucgagcgcaacaucaccaagaucguguaccugaccaacacgaccguggagaaggagaucugccccaagccggcggaguaccggaacuggucgaagccccagugcaagaucaccggguucgcccccuucuccaaggacaacagcauccgccucuccgccggcggggacaucugggucacccgggagcccuacgugucgugcgccccgaacaagugcuaccaguucgcccugggccaggggacgacccugaacaaccgccacuccaacgacaccgugcacgaccggacccccuaccgcacgcuccugaugaacgagcugggcauccccuuccaccucggcaccaagcaggucugcaucgcguggagcuccucguccugccacgacgggaaggccuggcugcacgugugcgugaccggccacgacaagaacgccaccgccagcuucaucuacgacgggcggcuggucgacuccaucggcucgugguccaagaacauccuccgcacgcaggagucggagugcgugugcaucaacgggaccugcaccguggucaugaccgacggcuccgcgagcggccgggccgacacgaagauccuguucaucaaggaggggaagaucauccacaucucccagcugucgggcagcgcccagcacguggaggagugcuccugcuacccccgcuacccgggggugcggugcgucugccgcgacaacuggaagggcucgaaccggcccaucguggacaucaacgugcgcgacuacuccaucgucagcuccuacgugugcucgggccucgugggggacacgccccggaagaacgacuccuucucguccagccacugccugaaccccaacaacgaggagggcgggcacggcgucaaggggugggccuucgacgacggcgacgacguguggaugggccgcaccaucuccgagaagcugcggucgggguacgagaccuucaaggucaucaagggcugguccaagccgaacagcaagcuccagaucaaccgccaggugaucguggaccgggggaaccgcuccggcuacucggggaucuucuccgucgagggcaagagcugcaucaaccggugcuucuacguggagcugauccgcggccgcaagcaggagaccgaggugugguggaccuccaacucgaucgucguguucugcgggaccagcggcaccuacgggacgggcuccuggcccgacggggccgacaucaaccugaugcccaucuga

SEQ ID NO: 28214 - RNA, 1410 nt, Artificial Sequence
  derived and/or modified CDS sequence (AUadapt) from InfluenzaA__AIT38361__NA
augaaccccaaccagaagaucaucaccaucggcucgaucucccugaccaucgccacgaucugcuuccucaugcaggucgccauccuggugaccaccgugacccugcacuucaagcaguacgagugcaacagcacgccgaacaaccaggugaugcucugcgagcccaccgucaucgagcgcaacaucaccaagaucguguaccugaccaacacgaccguggucaaggaggugugccccaagcccgcggaguaccggaacugguccaagccgcagugcaagaucaccggguucgcccccuucucgaaggacaacuccauccgccugagcgccggcggggacaucugggugacccgggagcccuacgucuccugcgcccccaacaagugcuaccaguucgcccucggccaggggacgacccugaacaaccgccacucgaacgacaccgugcacgaccggaccccguaccgcacgcugcucaugaacgagcugggcauccccuuccaccugggcaccaagcaggucugcaucgcgugguccagcuccucgugcuacgacgggaaggccuggcuccacgugugcgugaccggccacgacaagaacgccaccgccuccuucaucuacgacgggcggcugguggacagcaucggcuccuggucgaagaacauccugcgcacgcaggaguccgagugcgucugcaucaacgggaccugcaccguggugaugaccgacggcagcgcguccggccgggccgacacgaagauccucuucaucaaggaggggaagaucauccacaucucgcagcugagcggcuccgcccagcacgucgaggagugcucgugcuacccccgcuaccccggggugcggugcgugugccgcgacaacuggaagggcuccaaccggccgaucgucgacaucaacaugcgcgacuacagcaucguguccucguacgugugcuccggccuggucggggacacgccccgggagaacgacagcuucuccucgucccacugccucaaccccaacaacgaggagggcgggcacggcgugaaggggugggccuucgacgacggcgacgacgucuggaugggccgcaccaucagcgagaagcugcgguccggguacgagaccuucaaggugaucaagggcuggucgaagcccaacuccaagcugcagaucaaccgccaggugaucgucgaccgggggaaccgcagcggcuacuccgggaucuucucgguggagggcaaguccugcaucaaccggugcuucuacguggagcucauccgcggccgcaagcaggagaccgaggucugguggaccagcaacucgaucgugguguucugcgggaccuccggcaccuacgggacgggcagcuggccggacggggccgacaucaaccugaugcccaucuga

SEQ ID NO: 28215 - RNA, 1410 nt, Artificial Sequence
  derived and/or modified CDS sequence (AUadapt) from InfluenzaA__AIT38375__NA
augaaccccaaccagaagaucaucaccaucggcucggugugcaugaccaucgggauggucaaccugauccuccagaucggcaacaucaucuccaucuggaucagccacuccauccagcuggggaaccagaaccagaucgagaucugcaaccagagcgugaucacguacgagaacaacaccugggugaaccagaccuacgucaacaucuccaacaccaacuucgccgccggccagagcguggugccggucaagcuggcggggaacuccagccucugcuccgugagcggcugggccaucuacuccaaggacaacagcauccgcaucggcuccaagggggacguguucgucauccgggagcccuucaucucgugcagcccccuggagugccgcacguucuuccugacccagggcgcccuccugaacgacaagcacuccaacgggaccaucaaggaccggucccccuaccgcacccugaugagcugcccgaucggcgaggugcccucccccuacaacagccgguucgagagcguggccugguccgccagcgcgugccacgacgggaucaacuggcucacgaucggcaucuccggccccgacaacggggccgucgccgugcugaaguacaacggcaucaucaccgacaccaucaagagcuggcgcaacaacauccugcggacccaggaguccgagugcgccugcgugaacgggucgugcuucacggucaugaccgacggcccguccgacggccaggcgagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagucgaucagcucccggaacggcuucgagaugaucugggaccccaacggguggaccggcaccgacaacaacuucagcaucaagcaggacaucguggggaucaacgagugguccggcuacagcggguccuucguccagcacccggagcugaccggccuggacugcauccgccccugcuucuggguggagcucauccggggccgccccaaggagaacacgaucuggaccagcggguccagcaucuccuucugcggcgucaacagcgacaccguggggugguccuggcccgacggcgccgagcugccguucaccaucgacaaguga

SEQ ID NO: 28216 - RNA, 1410 nt, Artificial Sequence
  derived and/or modified CDS sequence (AUadapt) from InfluenzaA__AIT93148__NA
augaaccccaaccagaagaucaucaccaucggcucggugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccucgcucugcccgguguccggcugggccaucuacagcaaggacaacuccgugcgcaucggcagcaagggggacgucuucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacucgcgguucgaguccgucgccuggagcgcguccgccugccacgacgggaucaacuggcucaccaucggcaucagcggccccgacuccggggccguggccgugcugaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccucgaguaccagaucggguacaucugcuccggcguguucggggacaacccgcggcccaacgacaagaccggcagcugcggccccgucuccagcaacggggccaacggcgugaagggguucagcuucaaguacggcaacgggguguggaucggccgcaccaaguccaucucgucccggaagggcuucgagaugaucugggaccccaacggguggaccggcaccgacaacaaguucagcaucaagcaggacaucgucgggaucaacgagugguccggcuacagcggguccuucgugcagcacccggagcugacgggccuggacugcauccgccccugcuucugggucgagcucauccggggccgccccgaggagaacaccaucuggaccagcggguccagcaucuccuucugcggcgugaacagcgacaccguggggugguccuggcccgacggcgccgagcugccguucacgaucgacaaguga

SEQ ID NO: 28217 - RNA, 1410 nt, Artificial Sequence; identical to SEQ ID NO: 21042
  derived and/or modified CDS sequence (AUadapt) from InfluenzaA__AIU39701__NA

SEQ ID NO: 28218 - RNA, 1410 nt, Artificial Sequence; identical to SEQ ID NO: 16318
  derived and/or modified CDS sequence (AUadapt) from InfluenzaA__AIU39703__NA

SEQ ID NO: 28219 - RNA, 1410 nt, Artificial Sequence
  derived and/or modified CDS sequence (AUadapt) from InfluenzaA__AIU39705__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccgcggcccaacgacaacaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 28220 - RNA, 1413 nt, Artificial Sequence
  derived and/or modified CDS sequence (AUadapt) from InfluenzaA__AIU46611__NA
augaaucccaaccagaagaucacgugcaucucggccaccggcaugacccuguccguggucucgaugcucaucgggaucgccaaccugggccugaacaucgggcuccacuacaaggugggcgacuccaccaacaucaacaucccgaacaugaacgagaccucgcccaccacgaccaucaucaacaaucacccccagaacaacuucaccaacaucaccaacaucaucgugacgcgcaacgaggaggggcaccuccugaaccugaccaagccccugugcgaggucaacuccuggcacauccugucgaaggacaacgcgauccggaucggcgaggacgcccauaucaucgugacccgcgagccguaccucuccugcgacccccagggcugccggauguucgcccugucgcaggggaccacgcugcgcggcaagcacgccaacgggaccauccacgaccggucccccuuccgcgcccucgugucgugggagaugggccaggcgcccuccccguacaacacccgggucgagugcaucggguggaguuccaccucgugccacgacggcaucucccgcaugucgaucugcaucuccggccccaacaacaacgccucggccguggugugguacgggggccggcccgucacggagauccccuccugggccgggaacauccugcgcacccaggagucggagugcgugugccacggcggcaucuguccgguggucaugaccgacgggcccgcgaacaaccgggccgagaccaagaucaucuacuucaaggagggcaagaucaagaagaucgaggagcugaagggggacgcccagcacaucgaggagugcucgugcuacggcgccuccgagaugaucaagugcaucugccgcgacaacuggaagggggccaaccggcccgugaucacgaucgaucccgagaugaugacccacaccucgaaguaccucugcuccaagauccugaccgacacgucgcgcccgaacgaccccaccaacggcaacugcgaggcgcccaucaccggcgggucccccgacccgggcgugaagggguucgccuuccuggacggcgagaauucguggcucgggcggaccaucuccaaggacucgcgcuccggcuacgagaugcugaagguccccaacgccgagacggacacccagucgggcgccaucucccaccagaucaucgugaacaaccagaacuggucgggguacuccggcgccuucaucgacuacugggcgaauaaggagugcuucaaccccugcuucuacguggagcugauccgggggcgccccaaggagucguccguccucuggaccucgaacuccaucguggcccugugcggcucgaaggagcggcugggguccuggucguggcacgacggcgccgagaucaucuacuucaaguga

SEQ ID NO: 28221 - RNA, 1410 nt, Artificial Sequence
  derived and/or modified CDS sequence (AUadapt) from InfluenzaA__AIV09221__NA
augaaccccaaccagaagaucaucaccaucggcucggugugcaugaccaucgggauggccaaccugauccuccagaucggcaacaucacguccaucuggaucagccacuccauccagaucgggaaccgcaaccagaucgaggccugcaaccagagcgucaucaccuacgagaacaacaccugggugaaccagaccuacgugaacaucuccaacacgaacuucgcggucggccagagcguggugccggucaagcuggccgggaacuccucgcugugccccguguccggcugggccaucuacagcaaggacaacuccauccggaucggcagcaagggggacguguucgucauccgcgagcccuucaucuccugcagcccccucgagugccggaccuucuuccugacccagggcgcccugcucaacgacaagcacuccaacgggaccaucaaggaccgcagcccguaccggacgcugauguccugccccaucggcgaggugcccucgcccuacaacucccgcuucgagagcguggccuggagcgcguccgccugccacgacgggaucaacuggcugaccaucggcaucagcggcccggacaacggggccgucgccgugcucaaguacaacggcaucaucaccgacaccaucaaguccuggcggaacaacauccugcgcacgcaggagucggagugcgugugcgucaacggguccugcuucaccgugaugaccgacggccccagcaacggccaggcguccuacaagaucuuccggaucgagaaggggaagaucgucaagagcguggagaugaacgcccccaacuaccacuacgaggagugcuccugcuaccccgacagcuccgagaucacgugcgugugccgcgacaacuggcacggcagcaaccggccguggguguccuucaaccagaaccuggaguaccagaucggguacaucugcucgggcaucuucggggacaacccccgccccaacgacaagaccggcuccugcggccccgucccgagcaacggggccaacggcgugaagggguucuccuucaaguacggcaacgggguguggaucggccggaccaagagcaucuccagccgcaacggcuucgagaugaucugggaccccaacggguggaccgagaccgacaacgacuucucgaucaagcaggacaucgucggcaucaacgagugguccggguacagcggcuccuucgugcagcaccccgagcucacggggcuggacugcauccggcccugcuucugggucgagcugauccgcggccggccgaaggagaacaccaucuggaccagcggcuccagcaucuccuucugcggggugaacagcaacaccguggacugguccuggcccgacggcgccgagcuccccuucacgaucgacaaguga

SEQ ID NO: 28222 - RNA, 1410 nt, Artificial Sequence
  derived and/or modified CDS sequence (AUadapt) from InfluenzaA__AIW60703__NA
augaaccccaaccagaagaucaucaccaucggcucggugucccugaccaucgccacgaucugcuuccucaugcagaucgucauccuggugaccaccgugacccugcacuucaagcaguacgagugcaacucgccgcccaacaaccaggucaugcucugcgagcccacgaucaucgagcgcaacaucaccgagaucguguaccugaccaacaccacgaucgagaaggagaucugccccaagcuggccgaguaccggaacugguccaagccgcagugcaagaucaccggguucgcgcccuucagcaaggacaacuccauccgccucucggccggcggggacaucugggugacccgggagcccuacgucuccugcgaccccgacaagugcuaccaguucgcccugggccaggggaccacgcugaacaaccgccacagcaacgacaccgugcacgaccggaccccguaccgcacccuccugaugaacgagcugggcgugcccuuccaccucggcacgaagcaggucugcaucgccugguccucguccagcugccacgacgggaaggccuggcugcacgugugcgugaccggccacgacgagaacgcgaccgccuccuucaucuacgacgggcggcuggucgacucgaucggcuccuggagcaagaagauccuccgcacccaggaguccgagugcgugugcaucaacgggacgugcaccguggucaugaccgacggcucggccuccggccgggccgacaccaagauccuguucaucgaggaggggaagaucgugcacaucagcccccugucgggcuccgcgcagcacguggaggagugcucgugcuacccccaguacuccgggguccgcugcgugugccgggacaacuggaagggcagcaaccgcccgaucguggacaucaacgucaaggacuacuccaucgugucguccuacgugugcagcggccucgucggggacacgccccggaagaacgacuccucguccagcucccacugccugaaccccaacaacgaggagggcgggcacggcgugaaggggugggccuucgacgacggcaacgacgucuggaugggccgcaccaucucggagaagcugcgguccggguacgagaccuucaaggugaucggcggguggagcaagcccaacuccaagcuccagaucaaccgccaggugaucgucgaccggggcaaccgcucgggguacuccggcaucuucagcguggagggcaagaacugcaucaaccggugcuucuacguggagcugauccgcgggcggaagcaggagaccgaggucugguggacgucgaacuccaucgugguguucugcggcaccagcgggaccuacggcaccggguccuggccggacggcgccgacaucaaccugaugcccaucuga

SEQ ID NO: 28223 - RNA, 1410 nt, Artificial Sequence
  derived and/or modified CDS sequence (AUadapt) from InfluenzaA__AIW60704__NA
augaaccccaaccagaagaucaucaccaucggcucggugucccugaccaucgccacgaucugcuuccucaugcagaucgucauccuggugaccaccgugacccugcacuucaagcaguacgagugcaacagcccgcccaacaaccaggucaugcucugcgagcccacgaucaucgagcgcaacaucaccgagaucguguaccugaccaacaccacgaucgagaaggagaucugccccaagcuggccgaguaccggaacugguccaagccgcagugcaagaucaccggguucgcgcccuucucgaaggacaacuccauccgccucagcgccggcggggacaucugggugacccgggagcccuacgucuccugcgaccccgacaagugcuaccaguucgcccugggccaggggaccacgcugaacaaccgccacucgaacgacaucgugcacgaccggaccccguaccgcacccuccugaugaacgagcugggcgugcccuuccaccucggcaccaagcaggucugcaucgccugguccagcuccucgugccacgacgggaaggccuggcugcacgugugcgugacgggccacgacgagaacgcgaccgccuccuucaucuacgacgggcggcuggucgacagcaucggcuccuggucgaagaagauccuccgcacccaggaguccgagugcgugugcaucaacgggaccugcacgguggucaugaccgacggcagcgccuccggccgggccgacaccaagauccuguucaucgaggaggggaagaucgugcacaucucgccccugagcggcuccgcgcagcacguggaggagugcucgugcuacccccaguacuccgggguccgcugcgugugccgggacaacuggaagggcagcaaccgcccgaucguggacaucaacgucaaggacuacuccaucgugucguccuacgugugcagcggccucgucggggacacgccccggaagaacgacuccucguccagcucccacugccugaaccccaacaacgaggagggcgggcacggcgugaaggggugggccuucgacgacggcaacgacgucuggaugggccgcaccaucucggagaagcugcgguccggguacgagaccuucaaggugaucggcggguggagcaagcccaacuccaagcuccagaucaaccgccaggugaucgucgaccggggcaaccgcucgggguacuccggcaucuucagcguggagggcaagaacugcaucaaccggugcuucuacguggagcugauccgcgggcggaagcaggagaccgaggucugguggaccucgaacuccaucgugguguucugcggcacgagcgggaccuacggcaccggguccuggccggacggcgccgacaucaaccugaugcccaucuga

SEQ ID NO: 28224 - RNA, 1410 nt, Artificial Sequence
  derived and/or modified CDS sequence (AUadapt) from InfluenzaA__AIW60705__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccucguccagcugccacgacgggaaggcguggcugcacgugugcgugaccggccacgacgagaacgccaccgccuccuucaucuacgacgggcggcugguggacucgaucggcuccuggagcaagaagauccuccgcacccaggaguccgagugcgucugcaucaacgggacgugcaccguggugaugaccgacggcucggccuccggccgggcggacaccaagauccuguucaucgaggaggggaagaucguccacaucagcccccugucgggcuccgcccagcacguggaggagugcagcugcuacccccgcuacuccggggugcggugcgucugccgcgacaacuggaagggcucgaaccggccgaucguggacaucaacgugaaggacuacuccaucgucagcuccuacgugugcucgggccucgugggggacacgccccgcaagaacgacuccagcuccucgucccacugccugaaccccaacaacgaggagggcgggcacggcgucaaggggugggccuucgacgacggcaacgacguguggaugggccggaccaucagcgagaaguuccgcuccggguacgagaccuucaaggucaucggcggguggucgaagcccaacuccaagcugcagaucaaccgccaggugaucguggaccggggcaaccggagcggguacuccggcaucuucucggucgagggcaagagcugcaucaaccgcugcuucuacguggagcucauccgggggcgcaagcaggagaccgaggugugguggacguccaacucgaucgucguguucugcggcaccuccgggaccuacggcaccgggagcuggccggacggcgccgacaucaaccugaugcccaucuga

SEQ ID NO: 28225 - RNA, 1410 nt, Artificial Sequence; identical to SEQ ID NO: 28224
  derived and/or modified CDS sequence (AUadapt) from InfluenzaA__AIW60706__NA

SEQ ID NO: 28226 - RNA, 1410 nt, Artificial Sequence
  derived and/or modified CDS sequence (AUadapt) from InfluenzaA__AIW60708__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccucguccucgugccacgacgggaaggcguggcugcacgugugcgugaccggccacgacgagaacgccaccgccuccuucaucuacaacgggcggcugguggacagcaucggcuccuggucgaagaagauccuccgcacccaggaguccgagugcgucugcaucaacgggacgugcaccguggugaugaccgacggcagcgccuccggcaaggcggacaccaagauccuguucaucgaggaggggaagaucguccacaucucgccccugucgggcuccgcccagcacguggaggagugcagcugcuacccccgguacccgggggugcgcugcgucugccgggacaacuggaagggcuccaaccgccccaucguggacaucaacgugaaggacuacucgaucgucuccagcuacgugugcuccggccucgugggggacacgccccggaagaacgacucguccucguccagccacugccugaaccccaacaacgaggagggcgggcacggcgucaaggggugggccuucgacgacggcaacgacguguggaugggccgcaccaucuccgagaagcugcggucgggguacgagaccuucaaggucaucgagggcugguccaacccgaacagcaagcuccagaucaaccgccaggugaucguggaccgggggaacuccucgggcuacuccgggaucuucucggucgagggcaagagcugcaucaaccgcugcuucuacguggagcugauccggggccgcaagcaggagaccgaggugugguggacguccaacucgaucgucgugcugugcgggaccuccggcaccuacgggaccggcagcuggcccgacggggccgacaucaaccucaugcccaucuga

SEQ ID NO: 28227 - RNA, 1410 nt, Artificial Sequence
  derived and/or modified CDS sequence (AUadapt) from InfluenzaA__AIW60710__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccucgugccacgacggcaaggcguggcugcacgugugcgugaccggggacgacgagaacgccaccgccuccuucaucuacaacggccgccugguggacagcaucggguccuggucgaagaagauccuccggacccaggaguccgagugcgucugcaucaacggcacgugcaccguggugaugaccgacggcagcgccuccgggaaggcggacaccaagauccuguucaucgaggagggcaagaucguccacacgucgucgcuguccgggagcgcccagcacguggaggagugcuccugcuacccccgcuaccccggcgugcggugcgucugccgcgacaacuggaagggcucgaaccggccgaccguggacaucaacgugaaggacuacuccaucgucagcuccuacgugugcucggggcucgugggcgacacgccccgcaagaacgacuccucguccagcucccacugccuggaccccaacaacgaggagggcgggcacggggucaagggcugggccuucgacgacggcaacgacguguggauggggcggaccaucucggagaagcugcgcuccggcuacgagaccuucaaggucaucgagggguggagcaagcccaacuccaagcuccagaucaaccgccaggugaucguggaccggggcaaccggucgggguacuccggcaucuucucggucgagagcaaguccugcaucaaccgcugcuucuacguggagcugauccggggccgcaagcaggagaccgaggugcuguggaccucgaacuccaucgucguguucugcgggaccagcggcacguacgggaccggcuccuggccggacggggccgacaucaaccucaugcccaucuga

SEQ ID NO: 28228 - RNA, 1410 nt, Artificial Sequence; identical to SEQ ID NO: 16993
  derived and/or modified CDS sequence (AUadapt) from InfluenzaA__AIW60711__NA

SEQ ID NO: 28229 - RNA, 1410 nt, Artificial Sequence; identical to SEQ ID NO: 16993
  derived and/or modified CDS sequence (AUadapt) from InfluenzaA__AIW60712__NA

SEQ ID NO: 28230 - RNA, 1410 nt, Artificial Sequence
  derived and/or modified CDS sequence (AUadapt) from InfluenzaA__AIW60713__NA
augaaccccaaccagaagaucaucaccaucggcucggugucccugaccaucagcacgaucugcuucuucaugcagaucgccauccucaucaccaccgucacccugcacuucaagcaguacgaguucuccucgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugucggccggcggggacaucugggucacccgggagcccuacguguccugcgaccccgacaagugcuaccaguucgcccucggccaggggaccacgcugaacaacgugcacagcaacgacaccguccacgaccgcaccccguaccggacccugcucaugaacgagcugggcgugcccuuccaccugggcacgaagcaggucugcaucgccugguccucguccagcugccacgacgggaaggccuggcuccacgugugcgugaccggcgacgacaagaacgcgaccgccuccuucaucuacaacgggcgccugguggacagcaucgucuccuggucgaaggagauccugcggacccaggaguccgagugcgugugcaucaacggcacgugcaccguggucaugaccgacgggagcgccucgggcaaggccgacaccaagauccucuucaucgaggagggcaagaucgugcacacguccacccugagcggguccgcgcagcacguggaggagugcucgugcuacccccgcuaccccggcguccggugcgugugccgcgacaacuggaagggguccaaccggccgaucguggacaucaacaucaaggacuacagcaucgccuccucguacgucugcuccggccuggugggcgacacgccccgcaagaacgacagcuccagcuccucgcacugccucgaccccaacaacgaggagggcgggcacggggugaagggcugggccuucgacgacgggaacgacgucuggaugggccggaccaucuccgagaagcugcgcagcggcuacgagaccuucaaggugaucgaggggugguccaaccccaacucgaagcugcagaucaaccggcaggucaucguggaccgcggcaaccgguccggguacagcggcaucuucucgguggaggggaaguccugcaucaaccgcugcuucuacgucgagcucauccggggccgcaaggaggagaccgaggugcuguggaccagcaacuccaucguggucuucugcggcaccagcgggacguacggcaccggguccuggccggacggcgccgacaucaaccugaugcccaucuga

SEQ ID NO: 28231 - RNA, 1410 nt, Artificial Sequence
  derived and/or modified CDS sequence (AUadapt) from InfluenzaA__AIW60714__NA
augaaccccaaccagaagaucaucaccaucggcucggugucccugaccaucagcacgaucugcuucuucaugcagaucgccauccucaucaccaccgucacccugcacuucaagcaguacgaguucuccucgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugucggccggcggggacaucugggucacccgggagcccuacguguccugcgaccccgacaagugcuaccaguucgcccucggccaggggaccacgcugaacaacgugcacagcaacgacaccguccacgaccgcaccccguaccggacccugcucaugaacgagcugggcgugcccuuccaccugggcacgaagcaggucugcaucgccugguccucguccagcugccacgacgggaaggccuggcuccacgugugcgugaccggcgacgacaagaacgcgaccgccuccuucaucuacaacgggcgccugguggacagcaucgucuccuggucgaaggagauccugcggacccaggaguccgagugcgugugcaucaacggcacgugcaccguggucaugaccgacgggagcgccucgggcaaggccgacaccaagauccucuucaucgaggagggcaagaucgugcacacguccacccugagcggguccgcgcagcacguggaggagugcucgugcuacccccgcuaccccggcguccggugcgugugccgcgacaacuggaagggguccaaccggccgaucguggacaucaacaucaaggacuacagcaucgccuccucguacgucugcuccggccuggugggcgacacgccccgcaagaacgacagcuccagcuccucgcacugccucgaccccaacaacgaggagggcgggcacggggugaagggcugggccuucgacgacgggaacgacgucuggaugggccggaccaucuccgagaagcugcgcagcggcuacgagaccuucaaggugaucgaggggugguccaaccccaacucgaagcugcagaucaaccggcaggucaucgugggccgcgggaaccgguccggcuacagcgggaucuucucgguggagggcaaguccugcaucaaccgcugcuucuacgucgagcucauccggggccgcaaggaggagaccgaggugcuguggaccagcaacuccaucguggucuucugcgggaccagcggcacguacgggaccggcuccuggccggacggggccgacaucaaccugaugcccaucuga

SEQ ID NO: 28232 - RNA, 1410 nt, Artificial Sequence
  derived and/or modified CDS sequence (AUadapt) from InfluenzaA__AIW60715__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaagaagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggucaucguggaccggggcaaccgcucgggguacuccggcaucuucagcguggagggcaagucgugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 28233 - RNA, 1410 nt, Artificial Sequence; identical to SEQ ID NO: 18913
  derived and/or modified CDS sequence (AUadapt) from InfluenzaA__AIW60716__NA

SEQ ID NO: 28234 - RNA, 1410 nt, Artificial Sequence
  derived and/or modified CDS sequence (AUadapt) from InfluenzaA__AIY54970__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacgagaacgcgaccgccagcuucaucuacaacgggcgccugguggacuccaucgucagcugguccaagaagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaccgacuccagcuccagcucccacugccucgaccccaacaacgaggagggcgggcacggggucaagggcugggccuucgacgacgggaacgaccuguggaugggccggaccaucucgcagaaccugcgcuccggcuacgagaccuucaaggugaucgagggguggagcaaccccaacuccaagcuccagaucaaccggcaggucaucguggaccgcggcaaccggucgggguacuccggcaucuucagcguggagggcaagucgugcaucaaccgcugcuucuacgucgagcugauccgggggcgcaagcaggagaccgaggugcuguggaccuccaacagcaucguggucuucugcggcacguccgggaccuacggcaccgggagcuggccggacggcgccgacaucaaccucaugcccaucuga

SEQ ID NO: 28235 - RNA, 1410 nt, Artificial Sequence
  derived and/or modified CDS sequence (AUadapt) from InfluenzaA__AIY54974__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugagcgagcugggcgugcccuuccaccugggcacgaagcaggucugcaucgccugguccucguccagcugccacgacgggaaggccuggcuccacgugugcgugaccggcgacgacaagaacgcgaccgccuccuucaucuacaacgggcgccugguggacagcaucgucuccuggucgaagaagauccugcggacccaggaguccgagugcgugugcaucaacggcacgugcaccguggucaugaccgacgggagcgccucgggcaaggccgacaccaagauccucuucaucgaggagggcaagaucgugcacacguccacccugagcggguccgcgcagcacguggaggagugcucgugcuacccccgcuaccccggcguccggugcgugugccgcgacaacuggaagggguccaaccggccgaucguggacaucaacaucaaggacuacagcaucgucuccucguacgugugcuccggccuggugggcgacacgccccgcaagaacgacagcuccagcuccucgcacugccucgaccccaacaacgaggagggcgggcacggggucaagggcugggccuucgacgacgggaacgacguguggaugggccggaccaucuccgagaagcugcgcagcggcuacgagaccuucaaggucaucgaggggugguccaaccccaacucgaagcugcagaucaaccgccaggugaagguggaccggggcaaccgguccggguacagcggcaucuucucggucgaggggaaguccugcaucaaccgcugcuucuacguggagcucauccggggccgcaaggaggagaccaaggugcuguggaccagcaacuccaucgucguguucugcggcaccagcgggacguacggcaccggguccuggccggacggcgccgacaucaaccugaugcccaucuga

SEQ ID NO: 28236 - RNA, 1410 nt, Artificial Sequence
  derived and/or modified CDS sequence (AUadapt) from InfluenzaA__AIY54982__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggucguccagcuccugccacgacgggaaggccuggcuccacgugugcgugaccggcgacgacaagaacgcgaccgccucguucaucuacaacgggcgccugguggacuccaucgucagcugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcucgggccuggugggcgacacgccccgcaagaacgacuccagcuccucgucccacugccucgaccccaacaacgaggagggcgggcacggggucaagggcugggccuucgacgacgggaacgacguguggaugggccggaccaucagcgagaaguuccgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcugauccgggggcgcaaggaggagaccgaggugcucuggaccuccaacagcaucgucguguucugcggcaccuccgggacguacggcaccgggagcuggccggacggcgccgacaucaaccugaugcccaucuga

SEQ ID NO: 28237 - RNA, 1410 nt, Artificial Sequence
  derived and/or modified CDS sequence (AUadapt) from InfluenzaA__AIY54990__NA
augaaccccaaccagaagaucaucaccaucggcucggugucccugaccaucagcacgaucugcuucuucaugcagaucgccauccucaucaccaccgucacccugcacuucaagcaguacgaguucuccucgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgggaucaccggcuucgcgcccuucagcaaggacaacuccauccgccugucggccgggggcgacaucugggucacccgggagcccuacguguccugcgaccccgacaagugcuaccaguucgcccucgggcagggcaccacgcugaacaacgugcacagcaacgacaccguccacgaccgcaccccguaccggacccugcucaugaacgagcugggcgugcccuuccaccuggggacgaagcaggucugcaucgccugguccucguccagcugccacgacggcaaggccuggcuccacgugugcgugaccggggacgacaagaacgcgaccgccuccuucaucuacaacggccgccugguggacagcaucgucuccuggucgaaggagauccugcggacccaggaguccgagugcgugugcaucaacgggacgugcaccguggucaugaccgacggcagcgccucgggcaaggccgacaccaagauccucuucaucgaggaggggaagaucgugcacacguccacccugagcggcuccgcgcagcacguggaggagugcucgugcuacccccgcuaccccgggguccggugcgugugccgcgacaacuggaagggcuccaaccggccgaucguggacaucaacaucaaggacuacagcaucgucucccgcuacgugugcucgggccuggugggggacacgccccggaagaacgacuccagcuccagcucccacugccucgaccccaacaacgaggagggcgggcacggcgucaaggggugggccuucgacgacggcaacgacguguggaugggccgcaccaucucggagaagucccggagcggguacgagaccuucaaggucaucgagggcugguccaaccccaacucgaagcugcagaucaaccgccaggugaucguggaccgggggaaccgcuccggcuacagcgggaucuucucggucgagggcaaguccugcaucaaccggugcuucuacguggagcugauccgcggccggaaggaggagaccgaggugcucuggaccagcaacuccaucgucguguucugcgggaccagcggcacguacgggaccggcuccuggccggacggggccgacaucaaccugaugcccaucuga

SEQ ID NO: 28238 - RNA, 1401 nt, Artificial Sequence
  derived and/or modified CDS sequence (AUadapt) from InfluenzaA__AJD78177__NA
augaaccccaaccagaagaucaucgccaucggcucggugucccugaucaucgccgucaucugccuccugaugcagaucgcgauccugaccaccacgaugacccuccacuucaugcagaacgagugcucgaacccguccaacaaccaggugaugcccugcgagcccaucaucaucgagcgcaacaccgugcaccugaacaacaccacgaucgagcgggagaucugccccaaggccgccgaguacaagaacuggucgaagccgcagugccagaucaccggguucgcccccuucuccaaggacaacagcauccgccuguccgccggcggggacaucugggucacccgggagcccuacgugucgugcucccucgacaagugcuaccaguucgcgcugggccaggggaccacgcugaagaacaagcacucgaacggcaccacccacgaccgcacgccccaccggacccuccugaugaacgagcugggcgugccguuccaccucgggaccaagcaggucugcaucgccugguccagcuccucgugcuacgacggcaaggccuggcugcacaucugcgugaccggggacgacaagaacgccaccgcguccaucaucuacgacggcaugcugguggacucgaucggguccuggagcaagaacauccuccgcacgcaggaguccgagugcgucugcaucaacgggaccugcgccguggugaugaccgacggcucggccucgggcaaggccgacacccggguccuguucauccgcgagggcaagaucaucaacaucagcccccuguccggguccgcccagcacguggaggagugcucgugcuacccccgguaccccgaggugcgcugcgucugccgggacaacuggaagggcuccaaccgcccgauccucuacaucaacauggcggacuacucgaucgaguccagcuacgugugcuccggccuggugggggacacgccccggaacgacgacucguccucguccagcaacugccgcgaccccaacaacgagcggggcgcccccggggucaagggcugggccuucgacgacgggaacgacguguggaugggccgcaccaucaagaacggcucccggucgggguacgagaccuuccgcguggucaacggcuggaccauggccaacuccaagucgcagaucaaccgccaggugaucguggacuccgacgacuggagcggguacucgggcaucuucuccgucgaggggaagaagugcaucaaccggugcuucuacguggagcugauccggggccgcccgcaggagccccgcgucugguggacgucgaacuccaucaucguguucugcggcaccagcgggaccuacggcaccggguccuggcccgacggcgccaacaucaacuucaugcccaucuga

SEQ ID NO: 28239 - RNA, 1401 nt, Artificial Sequence
  derived and/or modified CDS sequence (AUadapt) from InfluenzaA__AJD78189__NA
augaaccccaaccagaagaucaucgccaucggcucggugucccugaucaucgccaucaucugccuccugaugcagaucgcgauccugaccaccacgaugacccuccacuuccgccagaacgagugcaacaacucguccaacaaccaggucaugccgugcgagcccaucaucaucgagcggaacaccgugcaccugaacagcaccacgaucgagcgcgagaucugccccaagguggccgaguacaagaacugguccaagccccagugccagaucaccggguucgccccguucucgaaggacaacuccauccggcugagcgccggcggggacaucugggucacccgcgagcccuacguguccugcucgcucgacaagugcuaccaguucgcccugggccaggggaccacgcugaagaacaagcacuccaacggcaccacccacgaccggaccucgcaccgcacgcuccugaugaacgagcugggcgugcccuuccaccucgggaccaagcaggucugcaucgcgugguccagcuccucgugcuacgacggcaaggccuggcugcacaucugcgugaccggggacgacaagaacgccaccgccuccaucaucuacaacggcaugcugguggacagcaucggguccuggucgaagaacauccuccggacgcaggagucggagugcgucugcaucaacgggaccugcgcgguggugaugaccgacggcuccgccagcggcaaggccgacacccgcguccuguucauccgggagggcaagaucaucaacaucucgccccuguccggguccgcccagcacguggaggagugcagcugcuacccgcgcuaccccgaggugcggugcgucugccgcgacaacuggaagggcuccaaccggcccauccucuacaucaacauggccgacuacucgaucgaguccucguacgugugcuccggccuggugggggacacgccccgcaacgacgacagcuccucguccagcaacugcaaggacccgaacuccgagcggggcgcgcccggggucaagggcugggccuucgacgacgggaacgacguguggaugggccgcaccaucaagaacggcucgcgguccggguacgagaccuuccgcgugcugaacggcuggaccgucgccaacucgaagagccagaucaaccgccaggugaucguggacuccgacgacuggucgggguacuccggcaucuucagcgucgaggggaagaagugcaucaaccggugcuucuacguggagcucauccggggccgcccccaggagccccgcgucugguggacguccaacucgaucaucguguucugcggcaccuccgggaccuacggcaccgggagcuggccggacggcgccaacaucaacuucaugcccaucuga

SEQ ID NO: 28240 - RNA, 1401 nt, Artificial Sequence
  derived and/or modified CDS sequence (AUadapt) from InfluenzaA__AJD78201__NA
augaaccccaaccagaagaucaccgccaucggcucggugucccugaucaucgccaucaucugccuccugaugcagaucgcgauccugaccacgaccaugacccuccacuuccgccagaaggagugcucgaacccguccaacaaccaggucaugcccugcgagcccaucaucaucgagcggaacaccgugcaccugaacucgacgaccaucgagcgcgagaucugccccaagguggccgaguacaagaacugguccaagccgcagugccugaucaccggguucgcccccuucagcaaggacaacuccauccggcucucggccggcggggacaucugggucacccgcgagcccuacguguccugcucgcccgacaagugcuaccaguucgcccugggccaggggacgacccugaagaacaagcacuccaacggcaccacccacgaccggacgccgcaccgcacccuccugaugaacgagcugggcgugcccuuccaccucgggaccaagcaggucugcaucgcguggagcuccucguccugcuacgacggcaaggccuggcugcacaucugcgugaccggggacgacaagaacgccacggccucgaucaucuacgacggcaugcugguggacuccaucgggagcugguccaagaacauccuccggacccaggagucggagugcgucugcaucaacgggaccugcgcgguggugaugaccgacggcucggccuccggcgucgccgacacgcgcgugcuguucauccgggagggcaagaucaucaacauccgcccccugagcggguccgcccagcacguggaggagugcucgugcuacccccgguacccggagguccgcugcgugugccgggacaacuggaagggcuccaaccgccccaucaucuacaucaacauggccgacuacucgaucgaguccagcuacgugugcuccggccucgucggggacacgccccggaacgacgacucguccucguccagcaacugccgcgaccccaacaacgagcggggcgcgccgggggugaagggcugggccuucgacgacgggaacgacguguggaugggccgcaccaucaagaacggcucccggucgggguacgagaccuuccgcgucaucaacggcuggaccauggccaacuccaagucgcagaucaaccgccaggugaucguggacuccgacgacuggagcggguacucgggcaucuucuccgucgaggggaagaagugcaucaaccggugcuucuacguggagcugauccgcggccggccccaggagccccgcgucugguggaccucgaacuccaucaucguguucugcggcaccagcgggaccuacggcacgggguccuggcccgacggcgccaacaucaacuucaugccgaucuga

SEQ ID NO: 28241 - RNA, 1401 nt, Artificial Sequence
  derived and/or modified CDS sequence (AUadapt) from InfluenzaA__AJD78213__NA
augaaccccaaccagaagaucaccgccaucggcucggugucccugaucaucgccaucaucugccucuucaugcagaucgcgauccugaccacgaccaugacccugcacuuccgccagaaggagugcucgaacccguccaacaaccaggucaugcccugcgagcccaucaucaucgagcggaacaccgugcaccucaacagcacgaccaucgagcgcgagaucugccccaagguggccgaguacaagaacugguccaagccgcagugccugaucaccggguucgcccccuucucgaaggacaacuccauccggcugucggccggcggggacaucugggucacccgcgagcccuacguguccugcagccccgacaagugcuaccaguucgcccucggccaggggacgacccugaagaacaagcacuccaacggcaccacccacgaccggacgccgcaccgcacccugcucaugaacgagcugggcgugcccuuccaccuggggaccaagcaggucugcaucgcguggucguccucguccugcuacgacggcaaggccuggcuccacaucugcgugaccggggacgacaagaacgccacggccagcaucaucuacgacggcaugcugguggacuccaucgggucgugguccaagaacauccugcggacccaggagucggagugcgucugcaucaacgggaccugcgcgguggugaugaccgacggcagcgccuccggcgucgccgacacgcgcguccucuucauccgggagggcaagaucaucaacauccgcccccugucgggguccgcccagcacguggaggagugcagcugcuacccccgguacccggaggugcgcugcgugugccgggacaacuggaagggcuccaaccgccccaucaucuacaucaacauggccgacuacucgaucgaguccucguacgugugcuccggccuggucggggacacgccccggaacgacgacagcuccucguccucgaacugccgcgaccccaacaacgagcggggcgcgccgggggugaagggcugggccuucgacgacgggaacgacguguggaugggccgcaccaucaagaacggcucccggagcggguacgagaccuuccgcgucaucaacggcuggaccauggccaacuccaagucgcagaucaaccgccaggugaucguggacuccgacgacuggucgggguacagcggcaucuucuccgucgaggggaagaagugcaucaaccggugcuucuacguggagcucauccgcggccggccccaggagccccgcgucugguggaccucgaacuccaucaucguguucugcggcaccagcgggaccuacggcacgggguccuggcccgacggcgccaacaucaacuucaugccgaucuga

SEQ ID NO: 28242 - RNA, 1410 nt, Artificial Sequence; identical to SEQ ID NO: 25324
  derived and/or modified CDS sequence (AUadapt) from InfluenzaA__AJI80140__NA

SEQ ID NO: 28243 - RNA, 1410 nt, Artificial Sequence; identical to SEQ ID NO: 25324
  derived and/or modified CDS sequence (AUadapt) from InfluenzaA__AJI80152__NA

SEQ ID NO: 28244 - RNA, 1410 nt, Artificial Sequence; identical to SEQ ID NO: 28100
  derived and/or modified CDS sequence (AUadapt) from InfluenzaA__AJI80164__NA

SEQ ID NO: 28245 - RNA, 1410 nt, Artificial Sequence; identical to SEQ ID NO: 28039
  derived and/or modified CDS sequence (AUadapt) from InfluenzaA__AJI80175__NA

SEQ ID NO: 28246 - RNA, 1410 nt, Artificial Sequence; identical to SEQ ID NO: 28039
  derived and/or modified CDS sequence (AUadapt) from InfluenzaA__AJI80187__NA

SEQ ID NO: 28247 - RNA, 1410 nt, Artificial Sequence; identical to SEQ ID NO: 28039
  derived and/or modified CDS sequence (AUadapt) from InfluenzaA__AJI80199__NA

SEQ ID NO: 28248 - RNA, 1410 nt, Artificial Sequence; identical to SEQ ID NO: 28039
  derived and/or modified CDS sequence (AUadapt) from InfluenzaA__AJI80211__NA

SEQ ID NO: 28249 - RNA, 1410 nt, Artificial Sequence; identical to SEQ ID NO: 16359
  derived and/or modified CDS sequence (AUadapt) from InfluenzaA__AJI80223__NA

SEQ ID NO: 28250 - RNA, 1410 nt, Artificial Sequence; identical to SEQ ID NO: 28039
  derived and/or modified CDS sequence (AUadapt) from InfluenzaA__AJI80235__NA

SEQ ID NO: 28251 - RNA, 1410 nt, Artificial Sequence; identical to SEQ ID NO: 16359
  derived and/or modified CDS sequence (AUadapt) from InfluenzaA__AJI80247__NA

SEQ ID NO: 28252 - RNA, 1410 nt, Artificial Sequence; identical to SEQ ID NO: 28058
  derived and/or modified CDS sequence (AUadapt) from InfluenzaA__AJI80259__NA

SEQ ID NO: 28253 - RNA, 1410 nt, Artificial Sequence; identical to SEQ ID NO: 16339
  derived and/or modified CDS sequence (AUadapt) from InfluenzaA__AJI80271__NA

SEQ ID NO: 28254 - RNA, 1410 nt, Artificial Sequence; identical to SEQ ID NO: 28039
  derived and/or modified CDS sequence (AUadapt) from InfluenzaA__AJI80283__NA

SEQ ID NO: 28255 - RNA, 1410 nt, Artificial Sequence
  derived and/or modified CDS sequence (AUadapt) from InfluenzaA__AJI80306__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggucgaagccccagugcgggaucaccggcuucgcgcccuucuccaaggacaacagcauccgccuguccgccgggggcgacaucugggucacccgggagcccuacgugucgugcgacccggacaagugcuaccaguucgcccuggggcagggcaccacgcucaacaacgugcacuccaacaacaccguccuggaccgcacccccuaccggacccugcucaugaacgagcugggcgugcccuuccaccuggggacgaagcaggucugcaucgccuggagcuccucguccugccacgacggcaaggccuggcuccacgugugcaucaccggggacgacaagaacgcgaccgccagcuucaucuacaacggccgccugguggacuccguggucucgugguccaaggagauccugcggacccaggagagcgagugcgugugcaucaacgggacgugcaccguggucaugaccgacggcuccgccucgggcaaggccgacaccaagauccucuucaucgaggaggggaagaucgugcacacgagcacccuguccggcucggcgcagcacguggaggagugcuccugcuacccccgcuacccggggguccggugcgugugccgcgacaacuggaagggcagcaaccggcccaucguggacaucaacaucaaggaccacuccaucgucucguccuacgugugcagcggccuggugggggacaccccgcgcaagaacgacuccucguccagcucccacugccucgaccccaacaacgaggagggcgggcacggcgucaaggggugggccuucgacgacggcaacgacguguggaugggccggaccaucaacgagacgucgcgccugggguacgagaccuucaaggucaucgagggcugguccaaccccaagagcaagcugcagaucaacaagcaggucaucguggaccgcggggaccgguccggcuacucggggaucuucuccguggagggcaagagcugcaucaaccggugcuucuacguggagcucauccgcggccggaaggaggagaccgaggugcuguggaccucgaacuccaucgucguguucugcgggacgagcggcaccuacgggaccggcuccuggcccgacggggccgaccugaaccucaugcccaucuga

SEQ ID NO: 28256 - RNA, 1410 nt, Artificial Sequence
  derived and/or modified CDS sequence (AUadapt) from InfluenzaA__AJI80318__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgaggccugcaaccagaacgucaucacguacgagaacaacaccugggugaaccagaccuacgugaacaucuccaacaccaacuucgcgacgggccagagcgucguguccgugaagcuggccgggaacucgucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcguggccugguccgcgagcgccugccacgacgggaucaacuggcucaccaucggcaucuccggccccgacagcggggccgucgccgugcugaaguacaacggcaucaucaccgacaccaucaaguccuggaagaacaacauccugcgcacgcaggagucggagugcgcgugcgugaacggguccugcuucaccaucaugaccgacggcccgagcgacggccaggccuccuacaagaucuuccggaucgagaaggggaagaucgucaagagcguggagaugaacgcccccaacuaccacuacgaggagugcuccugcuaccccgacagcuccgagaucacgugcgugugccgcgacaacuggcacggcagcaaccggcccugggucuccuucaaccagaaccucgaguaccagaucggguacaucugcucgggcguguucggggacaacccgcgccccaacgacaagaccggcuccugcggccccgugagcuccaacggggccaacggcgucaagggguucagcuucaaguacggcaacgggguguggaucggccggaccaagagcaucuccagccgcaagggcuucgagaugaucugggaccccaacggguggaccggcaccgacaacaacuucuccaucaagcaggacaucguggggaucaacgaguggucgggcuacuccgggagcuucguccagcacccggagcugacgggccuggacugcauccggcccugcuucuggguggagcucauccgcggccggcccaaggagaacaccaucuggaccuccgggagcuccaucagcuucugcggcgucaacuccgacaccgugggguggagcuggcccgacggcgccgagcugccguucacgaucgacaaguga

SEQ ID NO: 28257 - RNA, 1410 nt, Artificial Sequence
  derived and/or modified CDS sequence (AUadapt) from InfluenzaA__AJI80329__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccucgcucugcccggucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacucgcgguucgaguccguggccuggagcgcguccgccugccacgacgggaucaacuggcucaccaucggcaucagcggccccgacuccggggccgucgccgugcugaaguacaacggcaucaucaccgacaccaucaagagcuggaagaacaacauccugcgcacgcaggaguccgagugcgcgugcgugaacgggagcugcuucaccaucaugaccgacggcccguccgacggccaggccagcuacaagaucuuccggaucgagaaggggaagaucgucaaguccguggagaugaacgcccccaacuaccacuacgaggagugcucgugcuaccccgacuccagcgagaucacgugcgugugccgcgacaacuggcacggcuccaaccggcccugggucagcuucaaccagaaccucgaguaccagaucggguacaucugcuccggcguguucggggacaacccgcgccccaacgacaagaccggcagcugcggccccguguccagcaacggggccaacggcgucaagggguucagcuucaaguacggcaacgggguguggaucggccggaccaaguccaucucgucccgcaagggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 28258 - RNA, 1410 nt, Artificial Sequence
  derived and/or modified CDS sequence (AUadapt) from InfluenzaA__AJI80340__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcucgaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacuccggggccguggccguccugaaguacaacggcaucaucaccgacaccaucaagucguggaagaacaacauccugcgcacgcaggaguccgagugcgcgugcgugaacgggagcugcuucaccaucaugaccgacggcccguccgacggccaggccagcuacaagaucuuccggaucgagaaggggaagaucgugaaguccgucgagaugaacgcccccaacuacuacuacgaggagugcagcugcuaccccgacuccagcgagaucacgugcgugugccgcgacaacuggcacggcuccaaccggcccugggugagcuucaaccagaaccucgaguaccagaucggguacaucugcuccggcaucuucggggacaacccgcgccccaacgacaagaccggcagcugcggccccgucuccucgaacggggccaacggcgugaagggguucagcuucaaguacggcaacgggguguggaucggccggaccaaguccaucagcucccgcaagggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 28259 - RNA, 1410 nt, Artificial Sequence; identical to SEQ ID NO: 16339
  derived and/or modified CDS sequence (AUadapt) from InfluenzaA__AJI80351__NA

SEQ ID NO: 28260 - RNA, 1410 nt, Artificial Sequence
  derived and/or modified CDS sequence (AUadapt) from InfluenzaA__AJI80363__NA
augaaccccaaccagaagaucaucaccaucggcucggugucccugaccaucucgacgaucugcuucuucaugcagaucgccauccucaucaccaccgucacccugcacuucaagcaguacgaguucaacucccugccgaacaaccaggugaugcucugcgagcccacgaucaucgagcgcaacaucaccgagaucguguaccugaccaacaccacgaucgagaaggagaucugccccaagcccgccgaguaccggaacuggagcaagccgcagugcgggaucaccggcuucgcgcccuucuccaaggacaacucgauccgccuguccgccgggggcgacaucugggucacccgggagcccuacgugagcugcgaccccgacaagugcuaccaguucgcccucgggcagggcaccacgcugaacaacgugcacuccaacaacaccgcccgcgaccggaccccguaccgcacccugcucaugaacgagcugggcguccccuuccaccuggggacgaagcaggucugcaucgccuggucguccucguccugccacgacggcaaggcguggcuccacgugugcaucaccggggacgacaagaacgccaccgccagcuucaucuacaacggccggcugguggacuccguggugucgugguccaaggagauccugcgcacccaggagagcgagugcgucugcaucaacgggacgugcaccguggugaugaccgacggcuccgccucgggcaaggcggacaccaagauccucuucaucgaggaggggaagaucguccacacgagcacccuguccggcggggcccagcacguggaggagugcucgugcuacccccgguaccccggcgugcgcugcgucugccgggacaacuggaagggcuccaaccgcccgaucguggacaucaacaucaaggaccacucgaucguguccagcuacgucugcuccgggcuggugggcgacacgccccggaagaacgacucguccagcuccucgcacugccucaaccccaacaacgaggagggcgggcacggggugaagggcugggccuucgacgacggcaacgacgucuggauggggcgcaccaucaacgagaccucccggcugggcuacgagaccuucaaggugaucgagggguggucgaaccccaaguccaagcugcagaucaaccgccaggucaucguggaccggggcgaccgcagcggguacuccggcaucuucucgguggagggcaaguccugcaucaaccggugcuucuacgucgagcucauccgcgggcggaaggaggagaccgaggugcuguggaccagcaacucgaucguggucuucugcggcacguccgggaccuacggcaccgggagcuggccggacggcgccgaccugaaccucaugcccaucuga

SEQ ID NO: 28261 - RNA, 1410 nt, Artificial Sequence
  derived and/or modified CDS sequence (AUadapt) from InfluenzaA__AJI80375__NA
augaaccccaaccagaagaucaucaccaucggcucggugucccugaccaucucgacgaucugccucuucaugcagaucgccauccugaucaccaccgucacccugcacuucaagcagcacgaguucaacuccccgcccaacaaccaggugaugcucugcgagcccacgaucaucgagcgcaacaucaccgagaucguguaccugaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugucgugcgacccggacaagugcuaccaguucgcccucgggcagggcaccacgcugaacaacgugcacuccaacaacaccguccgcgaccggacccccuaccgcacccugcucaugaacgagcugggcgugcccuuccaccuggggacgaagcaggucugcaucgccuggagcuccucguccugccacgacggcaaggccuggcuccacgugugcaucaccggggacgacaagaacgcgaccgccagcuucaucuacaacggccggcugguggacuccguggucucgugguccaaggagauccugcgcacccaggagucggagugcgugugcaucaacgggacgugcaccguggucaugaccgacggcuccgccagcggcaaggccgacaccaagauccucuucaucgaggaggggaagaucgugcacacgucgacccuguccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccucgucccacugccucgaccccaacaacgaggagggcgggcacggcgucaaggggugggccuucgacgacggcaacgacguguggaugggccgcaccaucaacgagacgagccggcugggguacgagaccuucaaggucaucgagggcugguccaaccccaagucgaagcugcagaucaaccgccaggugaucguggaccgcggggaccgguccggcuacucggggaucuucuccgucgagggcaagagcugcaucaaccggugcuucuacguggagcucauccgcggccggaaggaggagaccgaggugcuguggaccucgaacuccaucgucguguucugcgggacgagcggcaccuacgggaccggcuccuggcccgacggggccgaccugaaccucaugcccaucuga

SEQ ID NO: 28262 - RNA, 1410 nt, Artificial Sequence; identical to SEQ ID NO: 28078
  derived and/or modified CDS sequence (AUadapt) from InfluenzaA__AJI80387__NA

SEQ ID NO: 28263 - RNA, 1410 nt, Artificial Sequence; identical to SEQ ID NO: 28078
  derived and/or modified CDS sequence (AUadapt) from InfluenzaA__AJI80398__NA

SEQ ID NO: 28264 - RNA, 1410 nt, Artificial Sequence; identical to SEQ ID NO: 28078
  derived and/or modified CDS sequence (AUadapt) from InfluenzaA__AJI80409__NA

SEQ ID NO: 28265 - RNA, 1410 nt, Artificial Sequence; identical to SEQ ID NO: 28078
  derived and/or modified CDS sequence (AUadapt) from InfluenzaA__AJI80420__NA

SEQ ID NO: 28266 - RNA, 1410 nt, Artificial Sequence; identical to SEQ ID NO: 28078
  derived and/or modified CDS sequence (AUadapt) from InfluenzaA__AJI80431__NA

SEQ ID NO: 28267 - RNA, 1410 nt, Artificial Sequence; identical to SEQ ID NO: 28073
  derived and/or modified CDS sequence (AUadapt) from InfluenzaA__AJI80442__NA

SEQ ID NO: 28268 - RNA, 1410 nt, Artificial Sequence; identical to SEQ ID NO: 28078
  derived and/or modified CDS sequence (AUadapt) from InfluenzaA__AJI80454__NA

SEQ ID NO: 28269 - RNA, 1410 nt, Artificial Sequence; identical to SEQ ID NO: 28073
  derived and/or modified CDS sequence (AUadapt) from InfluenzaA__AJI80465__NA

SEQ ID NO: 28270 - RNA, 1410 nt, Artificial Sequence; identical to SEQ ID NO: 28078
  derived and/or modified CDS sequence (AUadapt) from InfluenzaA__AJI80477__NA

SEQ ID NO: 28271 - RNA, 1410 nt, Artificial Sequence; identical to SEQ ID NO: 28078
  derived and/or modified CDS sequence (AUadapt) from InfluenzaA__AJI80488__NA

SEQ ID NO: 28272 - RNA, 1410 nt, Artificial Sequence; identical to SEQ ID NO: 28100
  derived and/or modified CDS sequence (AUadapt) from InfluenzaA__AJI80499__NA

SEQ ID NO: 28273 - RNA, 1410 nt, Artificial Sequence; identical to SEQ ID NO: 28078
  derived and/or modified CDS sequence (AUadapt) from InfluenzaA__AJI80510__NA

SEQ ID NO: 28274 - RNA, 1410 nt, Artificial Sequence; identical to SEQ ID NO: 28100
  derived and/or modified CDS sequence (AUadapt) from InfluenzaA__AJI80521__NA

SEQ ID NO: 28275 - RNA, 1410 nt, Artificial Sequence
  derived and/or modified CDS sequence (AUadapt) from InfluenzaA__AJJ98767__NA
augaaccccaaccagaagaucaucaccaucggcucggugucccugaccaucucgacgaucugcuucuucaugcagaucgccauccucaucaccaccgucacccugcacuucaagcaguacgaguucaacuccccgagcaacaaccaggugaugcugugcgagcccacgaucaucgagcgcaacaucaccgagaucguguaccucaccaacaccacgaucgagaaggagaagugccccaagcccgccgaguaccggaacugguccaagccgcagugcgacaucaccggguucgcgcccuucucgaaggacaacuccauccgccugagcgccggcggggacaucugggucacccgggagcccuacguguccugcgaccccgacaagugcuaccaguucgcccugggccaggggaccacgcucaacaacgugcacucgaacaacaccguccgcgaccggaccccguaccgcacccugcugaugaacgagcucggcgugcccuuccaccugggcacgaagcaggucugcaucgccugguccagcuccucgugccacgacgggaaggccuggcugcacgugugcaucaccggcgacgacaagaacgcgaccgccuccuucaucuacaacgggcggcucguggacagcguggucuccuggucgaaggagauccugcgcacccaggaguccgagugcgugugcaucaacggcacgugcaccguggucaugaccgacgggagcgccucgggcaaggccgacaccaagauccuguucaucgaggagggcaagaucgugcacacguccacccucagcggguccgcgcagcacguggaggagugcucgugcuacccccgguaccccggcguccgcugcgugugccgggacaacuggaagggguccaaccgcccgaucguggacaucaacaucaaggaccacagcaucgucuccucguacgugugcuccggccuggugggcgacacgccccggaagaacgacagcuccucguccagccacugccuggaccccaacaacgaggagggcgggcacggggucaagggcugggccuucgacgacggggacgacguguggaugggccgcaccaucuccgagaagucccggcucggcuacgagaccuucaaggucaucgagggguggucgaaccccaagagcaagcugcagaucaaccgccaggugaucguggaccggggcaaccgcuccggguacucgggcaucuucagcgucgaggggaaguccugcaucaaccggugcuucuacguggagcugauccgcggccggaaggaggagaccgacgugcucuggaccucgaacuccaucgucguguucugcggcaccagcgggacguacggcaccggguccuggccggacggcgccgacaucaaccugaugcccaucuga

SEQ ID NO: 28276 - RNA, 1410 nt, Artificial Sequence
  derived and/or modified CDS sequence (AUadapt) from InfluenzaA__AJJ98779__NA
augaaccccaaccagaagaucaucaccaucggcucggugucccugaccaucucgacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggacgacccucaacaacgugcacuccaacgacaccguccgcgaccggacccccuaccgcacgcugcugaugaacgagcucggcgugcccuuccaccugggcaccaagcaggucugcaucgccuggucguccucguccugccacgacgggaaggccuggcugcacgugugcaucaccggcgacgacaagaacgcgaccgccagcuucaucuacaacgggcggcucguggacuccaucgugucguggacgaaggagauccugcgcacccaggaguccgagugcgucugcaucaacgggaccugcaccguggugaugacggacgggagcgccuccggcaaggccgacaccaagauccuguucaucgaggagggcaagaucguccacaccucgacccucagcggguccgcgcagcacguggaggagugcucgugcuacccccgguacccgggcgugcgcugcgucugccgggacaacuggaagggguccaaccgccccaucguggacaucaacaucaaggaccacucgaucguguccagcuacgucugcuccggccuggugggcgacacgccccggaagaacgacucguccagcuccucgcacugccuggaccccaacaacgaggagggcggccacggggugaagggcugggccuucgacgacgggaacgacgucuggaugggccgcaccaucuccgagaagucccggcucggcuacgagaccuucaaggugaucgagggguggucgaaccccaagagcaagcugcagaucaaccgccaggucaucguggaccggggcaaccgcuccggguacucgggcaucuucuccguggagggcaagagcugcaucaaccggugcuucuacgucgagcugauccgcgggcggaaggaggagaccgaggugcucuggacgucgaacuccaucguggucuucugcggcaccagcgggaccuacggcaccggguccuggccggacggcgccgacaucaaccugaugcccaucuga

SEQ ID NO: 28277 - RNA, 1410 nt, Artificial Sequence; identical to SEQ ID NO: 16339
  derived and/or modified CDS sequence (AUadapt) from InfluenzaA__AJJ98791__NA

SEQ ID NO: 28278 - RNA, 1410 nt, Artificial Sequence
  derived and/or modified CDS sequence (AUadapt) from InfluenzaA__AJJ98803__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaagguccgcgaccggacccccuaccgcacccugcugaugaacgagcucggcgugcccuuccaccuggggaccaagcaggucugcaucgccuggucguccagcuccugccacgacggcaaggccuggcugcacgugugcaucacgggggacgacaagaacgcgaccgccucguucaucuacaacggccggcucguggacuccguggucagcugguccaaggagauccugcgcacccaggagucggagugcgugugcaucaacgggaccugcacgguggucaugaccgacggcuccgccagcggcaaggccgacaccaagauccuguucaucgaggaggggaagaucgugcacaccucgacgcucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagaccucgcggcucggguacgagacguucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggaccagcggcacguacgggaccggcuccuggcccgacggggccgaccugaaccugaugcccaucuga

SEQ ID NO: 28279 - RNA, 1410 nt, Artificial Sequence; identical to SEQ ID NO: 16339
  derived and/or modified CDS sequence (AUadapt) from InfluenzaA__AJJ98815__NA

SEQ ID NO: 28280 - RNA, 1410 nt, Artificial Sequence
  derived and/or modified CDS sequence (AUadapt) from InfluenzaA__AJJ98827__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccucguccugccacgacggcaaggccuggcugcacgugugcaucaccggggacgacaagaacgcgaccgccagcuucaucuacaacggccggcucguggacuccguggucucgugguccaaggagauccugcgcacccaggagagcgagugcgugugcaucaacgggacgugcaccguggucaugaccgacggcuccgccucgggcaaggccgacaccaagauccuguucaucgaggaggggaagaucgugcacacgagcacccucuccggcucggcgcagcacguggaggagugcuccugcuacccccgguacccggggguccgcugcgugugccgggacaacuggaagggcucgaaccgccccaucguggacaucaacaucaaggaccacaacaucgucuccagcuacgugugcuccggccuggugggggacacgccccggaagaacgacucguccagcuccucgcacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggucgaacccgaaguccaagcugcagaucaaccgccaggugaucguggaccgcggggaccggagcggcuacuccgggaucuucucggucgagggcaaguccugcaucaaccggugcuucuacguggagcugauccgcggccggaaggaggagaccgaggugcucuggaccagcaacucgaucgucguguucugcgggacguccggcaccuacgggaccggcagcuggcccgacggggccgaccugaaccugaugcccaucuga

SEQ ID NO: 28281 - RNA, 1410 nt, Artificial Sequence; identical to SEQ ID NO: 23545
  derived and/or modified CDS sequence (AUadapt) from InfluenzaA__AJJ98839__NA

SEQ ID NO: 28282 - RNA, 1410 nt, Artificial Sequence; identical to SEQ ID NO: 21920
  derived and/or modified CDS sequence (AUadapt) from InfluenzaA__AJJ98851__NA

SEQ ID NO: 28283 - RNA, 1410 nt, Artificial Sequence
  derived and/or modified CDS sequence (AUadapt) from InfluenzaA__AJJ98863__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgagcggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcaucugcaucaacggcacgugcaccguggugaugaccgacggguccgccagcggcaaggccgacaccaagauccuguucaucgaggagggcaagaucguccacacgucgacccucuccgggagcgcgcagcacguggaggagugcuccugcuacccccgguacccgggcgugcgcugcgucugccgggacaacuggaaggggucgaaccgccccaucguggacaucaacaugaaggaccacuccaucgugagcuccuacgucugcucgggccuggugggcgacacgccccggaagaacgacuccagcuccucgucccacugccuggaccccaacaacgaggagggcgggcacggggugaagggcugggccuucgacgacgggaacgacgucuggaugggccgcaccaucagcgagaagucccggcucggcuacgagaccuucaaggugaucgagggguggucgaacccgaaguccaagcugcagaucaaccgccaggucaucguggaccggggcaaccgcagcggguacuccggcaucuucucgguggagggcaagagcugcaucaaccggugcuucuacgucgagcugauccgcgggcggaaggaggagaccgaggugcucuggaccuccaacucgaucguggucuucugcggcaccuccgggacguacggcaccgggagcuggcccgacggcgccgacaucaaccugaugcccaucuga

SEQ ID NO: 28284 - RNA, 1410 nt, Artificial Sequence
  derived and/or modified CDS sequence (AUadapt) from InfluenzaA__AJJ98875__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacgacaccguccgcaaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggagcgcgcagcacguggaggagugcuccugcuacccccgguacccgggcguccgcugcgugugccgggacaacuggaaggggucgaaccgccccaucguggacaucaacaucaaggaccacuccaucgucagcuccuacgugugcucgggccuggugggcgacacgccccggaagaacgacuccagcuccucgucccacugccuggaccccaacaacgaggagggcgggcacggggucaagggcugggccuucgacgacgggaacgacguguggaugggccgcaccaucagcgagaagucccggcucggcuacgagaccuucaaggucaucgagggguggucgaacccgaaguccaagcugcagaucaaccgccaggugaucguggaccggggcaaccgcagcggguacuccggcaucuucucggucgagggcaagagcugcaucaaccggugcuucuacguggagcugauccgcgggcggaaggaggagaccgaggugcucuggaccuccaacucgaucgucguguucugcggcaccuccgggacguacggcaccgggagcuggcccgacggcgccgacaucaaccugaugcccaucuga

SEQ ID NO: 28285 - RNA, 1410 nt, Artificial Sequence
  derived and/or modified CDS sequence (AUadapt) from InfluenzaA__AJJ98887__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcaaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggucaucguggaccggggcaaccgcucgggguacuccggcaucuucagcguggagggcaagucgugcaucaaccggugcuucuacgucgagcucauccgcgggcggaaggaggagaccgacgugcuguggaccuccaacagcaucguggucuucugcggcaccuccgggacguacggcaccgggagcuggccggacggcgccgacaucaaccugaugcccaucuga

SEQ ID NO: 28286 - RNA, 1410 nt, Artificial Sequence
  derived and/or modified CDS sequence (AUadapt) from InfluenzaA__AJJ98899__NA
augaaccccaaccagaagaucaucaccaucggcucggugucccugaccaucucgacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggacgacccugaacaacgugcacuccaacaacaccguccgcaaccggaccccguaccgcacgcugcucaugaacgagcugggcgugcccuuccaccugggcaccaagcaggucugcaucgccuggucguccagcuccugccacgacgggaaggccuggcuccacgugugcaucaccggcgacgacaagaacgcgaccgccucguucaucuacaacgggcggcugguggacuccaucgugagcugguccaaggagauccugcgcacgcaggagucggagugcgucugcaucaacgggaccugcaccguggugaugaccgacggguccgccagcggcaaggccgacacgaagauccucuucaucgaggagggcaagaucguccacaccucgacccuguccgggagcgcgcagcacguggaggagugcuccugcuacccccgguaccccggcgugcgcugcgucugccgggacaacuggaaggggucgaaccgcccgaucguggacaucaacaucaaggaccacuccaucgugagcuccuacgucugcucgggccuggugggcgacacgccccggaagaacgacuccagcuccucgucccacugccucgaccccaacaacgaggagggcggccacggggugaagggcugggccuucgacgacgggaacgacgucuggaugggccgcaccaucagcgagaagucccggcugggcuacgagaccuucaaggugaucgagggguggucgaaccccaaguccaagcugcagaucaaccgccaggucaucguggaccggggcaaccgcagcggguacuccggcaucuucucgguggagggcaagagcugcaucaaccggugcuucuacgucgagcucauccgcgggcggaaggaggagaccgaggugcuguggaccuccaacucgaucguggucuucugcggcacguccgggaccuacggcaccgggagcuggccggacggcgccgacaucaaccugaugcccaucuga

SEQ ID NO: 28287 - RNA, 1410 nt, Artificial Sequence; identical to SEQ ID NO: 16339
  derived and/or modified CDS sequence (AUadapt) from InfluenzaA__AJJ98911__NA

SEQ ID NO: 28288 - RNA, 1410 nt, Artificial Sequence; identical to SEQ ID NO: 25324
  derived and/or modified CDS sequence (AUadapt) from InfluenzaA__AJJ98923__NA

SEQ ID NO: 28289 - RNA, 1410 nt, Artificial Sequence
  derived and/or modified CDS sequence (AUadapt) from InfluenzaA__AJJ98935__NA
augaaccccaaccagaagaucaucaccaucggcucggugucccugaccaucucgacgaucugcuucuucaugcagaucgccauccucaucaccaccgucacccugcacuucaagcgcuacgaguucaacuccccgcccaacaaccaggugaugcugugcgagcccacgaucaucgagcggaacaucaccgagaucguguaccucaccaacaccacgaucgagaaggagaucugccccaagccggccgaguaccgcaacuggagcaagccccagugcgggaucaccggcuucgcgcccuucuccaaggacaacucgauccggcuguccgccgggggcgacaucugggucacccgcgagcccuacgugagcugcgacccggacaagugcuaccaguucgcccuggggcagggcaccacgcucaacaacgugcacuccaacaacaccguccgggaccgcacccccuaccggacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccgccucguggacuccguggucagcugguccaaggagauccugcggacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgcuacccggggguccggugcgugugccgcgacaacuggaagggcagcaaccggcccaucguggacaucaacaucaaggaccacuccaucgucucguccuacgugugcagcggccuggugggggacaccccgcgcaagaacgacuccucguccagcucccacugccuggaccccaacaacgaggagggcgggcacggcgucaaggggugggccuucgacgacggcaacgacguguggaugggccggaccaucaacgagacgucgcgccucggguacgagaccuucaaggucaucgagggcugguccaaccccaagagcaagcugcagaucaaccggcaggucaucguggaccgcggggaccgguccggcuacucggggaucuucuccguggagggcaagagcugcaucaaccgcugcuucuacguggagcugauccggggccgcaaggaggagaccgaggugcucuggaccucgaacuccaucgucguguucugcgggacgagcggcaccuacgggaccggcuccuggcccgacggggccgaccugaaccugaugcccaucuga

SEQ ID NO: 28290 - RNA, 1410 nt, Artificial Sequence
  derived and/or modified CDS sequence (AUadapt) from InfluenzaA__AJJ98947__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugacgcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggucguccagcuccugccacgacgggaaggccuggcuccacgugugcaucaccggcaacgacaagaacgcgaccgccucguucaucuacaacgggcggcugguggacuccguggucagcugguccaaggagauccugcgcacgcaggagucggagugcgugugcaucaacgggaccugcaccguggucaugaccgacggguccgccagcggcaaggccgacacgaagauccucuucaucgaggagggcaagaucgugcacaccucgacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcggccacggggucaagggcugggccuucgacgacgggaacgacguguggaugggccgcaccaucaacgagaccucgcggcugggcuacgagaccuucaaggucaucgaggggugguccaaccccaagagcaagcugcagaucaaccgccaggugaucguggaccggggcaaccgcuccggguacucgggcaucuucuccgucgagggcaagagcugcaucaaccggugcuucuacguggagcucauccgcgggcggaaggaggagaccgaggugcuguggacgucgaacuccaucgucguguucugcggcaccagcgggaccuacggcaccggguccuggccggacggcgccgaccugaaccucaugcccaucuga

SEQ ID NO: 28291 - RNA, 1410 nt, Artificial Sequence
  derived and/or modified CDS sequence (AUadapt) from InfluenzaA__AJJ98971__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcaaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 28292 - RNA, 1410 nt, Artificial Sequence
  derived and/or modified CDS sequence (AUadapt) from InfluenzaA__AJJ98995__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaugaccgagaucguguaccucaccaacaccacgaucgagaaggagaucugccccaagccggccgaguaccggaacuggucgaagccccagugcgacaucaccggguucgcgcccuucuccaaggacaacagcauccgccuguccgccggcggggacaucugggucacccgggagcccuacgugucgugcgacccggacaagugcuaccaguucgcccugggccaggggaccacgcucaacaacgugcacuccaacaacaucguccgcgaccggacccccuaccgcacccugcugaugaacgagcucggcgugcccuuccaccugggcaccaagcaggucugcaucgccuggagcuccucguccugccacgacgggaaggccuggcugcacgugugcaucacgggcgacgacaagaacgcgaccgccagcuucaucuacaacgggcggcucguggacuccguggucucgugguccaaggagauccugcgcacccaggagagcgagugcgugugcaucaacgggaccugcacgguggucaugaccgacggguccgccucgggcaaggccgacaccaagauccuguucaucgaggagggcaagaucgugcacaccagcacgcucuccgggucggcgcagcacguggaggagugcuccugcuacccccgguacccgggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccuggaccccaacaacgaggagggcggccacggggucaagggcugggccuucgacgacgggaacgacguguggaugggccgcaccaucaacgagaccucgcggcucggcuacgagacguucaaggucaucgaggggugguccaaccccaagagcaagcugcagaucaaccgccaggugaucguggaccgguccgaccgcucgggcuacuccgggaucuucagcgucgagggcaagucgugcaucaaccggugcuucuacguggagcugauccgcgggcggaaggaggagaccgaggugcucuggaccuccaacagcaucgucguguucugcggcaccuccggcacguacgggaccggcagcuggcccgacggggccgaccugaaccugaugcccaucuga

SEQ ID NO: 28293 - RNA, 1410 nt, Artificial Sequence; identical to SEQ ID NO: 23545
  derived and/or modified CDS sequence (AUadapt) from InfluenzaA__AJJ99007__NA

SEQ ID NO: 28294 - RNA, 1410 nt, Artificial Sequence
  derived and/or modified CDS sequence (AUadapt) from InfluenzaA__AJJ99019__NA
augaaccccaaccagaagaucaucaccaucggcucggugucccugaccaucagcacgaucugcuucuucaugcagaccgccauccucaucaccaccgucacgcugcacuucaagcagugcgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacgcaggagagcgagugcgugugcaucaacgggaccugcaccguggucaugaccgacggguccgccucgggcaaggccgacacgaagauccucuucaucgaggagggcaagaucgugcacaccagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucgaacuacgugugcuccggccuggugggcgacacgccccggaagaacgacagcuccucguccagccacugccucgaccccaacaacgaggagggcggccacggggucaagggcugggccuucgacgacgggaacgacguguggaugggccgcaccaucuccgagaagucccgguucggcuacgagaccuucaaggucaucgagggguggucgaaccccaagagcaagcugcagaucaaccgccaggugaucguggaccggggcaaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcacgagcgggaccuacggcaccggguccuggccggacggcgccgacaucaaccugaugcccaucuga

SEQ ID NO: 28295 - RNA, 1410 nt, Artificial Sequence
  derived and/or modified CDS sequence (AUadapt) from InfluenzaA__AJJ99031__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgaucaacaacgugcacuccaacgacaccguccgcgaccggaccccguaccgcacccugcugaugaacgagcucggcgugcccuuccaccugggcacgaagcaggucugcaucgccuggagcuccucguccugccacgacgggaaggccuggcugcacgugugcaucaccggcgacgacaagaacgcgaccgccagcuucaucuacaacgggcggcucguggacuccguggucucgugguccaaggagauccugcgcacccaggagagcgagugcgugugcaucaacggcacgugcaccguggucaugaccgacggguccgccucgggcaaggccgacaccaagauccuguucaucgaggagggcaagaucgugcacacgagcacccucuccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccuggaccccaacaacgaggagggcgggcacggggucaagggcugggccuucgacgacgggaacgacguguggaugggccgcaccaucucggagaagucccggcucggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcugauccgcgggcggaaggaggagaccgaggugcucuggaccuccaacagcaucgucguguucugcggcaccuccgggacguacggcaccgggagcuggccggacggcgccgacaucaaccugaugcccaucuga

SEQ ID NO: 28296 - RNA, 1410 nt, Artificial Sequence
  derived and/or modified CDS sequence (AUadapt) from InfluenzaA__AJJ99043__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaaguggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcggcugguggacuccaucgucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggcgcgggagcaaccggccgaucguggacaucaacaugaaggacuacuccaucgucucguccuacgugugcagcggccuggugggcgacacgccccgcaagaacgacuccucguccagcgggcacugccucgaccccaacaacgaggagggcgggcacggcgucaaggggugggccuucgacgacggcaacgacguguggaugggccggaccaucuccgagaagucccgcucgggguacgagaccuucaaggucaucgagggcuggagcaaccccaacuccaagcugcagaucaaccgccaggugaucguggaccgggggaaccggucgggcuacuccgggaucuucagcgucgagggcaagucgugcaucaaccgcugcuucuacguggagcugauccggggccgcaaggaggagaccgaggugcucuggaccuccaacagcaucgucguguucugcgggaccuccggcacguacgggaccggcagcuggccggacggggccgacaucaaccugaugcccaucuga

SEQ ID NO: 28297 - RNA, 1410 nt, Artificial Sequence
  derived and/or modified CDS sequence (AUadapt) from InfluenzaA__AJJ99067__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcggccggacccccuaccgcacccugcugaugaacgagcucggggugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggacauccugcgcacccaggagucggagugcgugugcaucaacggcacgugcaccguggucaugaccgacggcuccgccagcgggaaggccgacaccaagauccuguucaucgaggagggcaagaucgugcacacgucgacccucuccgggucggcgcagcacguggaggagugcuccugcuacccccgguacccgggcguccgcugcgugugccgggacaacuggaagggcagcaaccgccccaucguggacaucaacaucaaggaccacuccaucgucucguccuacgugugcagcgggcuggugggcgacaccccgcggaagaacgacuccucguccagcucccacugccuggaccccaacaacgaggagggcgggcacggggucaagggcugggccuucgacgacggcaacgacguguggauggggcgcaccaucaacgagacgucgcggcucggcuacgagaccuucaaggucaucgaggggugguccaaccccaagagcaagcugcagaucaaccgccaggugaucguggaccggggcgaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcacgagcgggaccuacggcaccggguccuggcccgacggcgccgaccugaaccugaugcccaucuga

SEQ ID NO: 28298 - RNA, 1410 nt, Artificial Sequence
  derived and/or modified CDS sequence (AUadapt) from InfluenzaA__AJJ99079__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcaaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 28299 - RNA, 1410 nt, Artificial Sequence
  derived and/or modified CDS sequence (AUadapt) from InfluenzaA__AJJ99091__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgaccucuggaugggccgcaccaucaacgagacgucgcggcugggguacgagaccuucaaggugaucgagggcugguccaaccccaagagcaagcugcagaucaaccgccaggucaucguggaccgcggggaccgguccggcuacucggggaucuucuccguggagggcaagagcugcaucaaccggugcuucuacgucgagcucauccgcggccggaaggaggagaccgaggugcuguggaccucgaacuccaucguggucuucugcgggacgagcggcaccuacgggaccggcuccuggcccgacggggccgaccugaaccucaugcccaucuga

SEQ ID NO: 28300 - RNA, 1410 nt, Artificial Sequence
  derived and/or modified CDS sequence (AUadapt) from InfluenzaA__AJJ99103__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaugaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcaaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggagcgcgcagcacguggaggagugcuccugcuacccccgguacccgggcguccgcugcgugugccgggacaacuggaaggggucgaaccgccccaucguggacaucaacaucaaggaccacuccaucgucagcuccuacgugugcucgggccuggugggcgacaccccgcggaagaacgacuccagcuccucgucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagucgaagcugcagaucaaccgccaggugaucguggaccgguccgaccgcagcggcuacuccgggaucuucucggucgagggcaagagcugcaucaaccggugcuucuacguggagcugauccgcgggcggaaggaggagaccgaggugcucuggaccuccaacucgaucgucguguucugcggcacguccggcaccuacgggaccggcagcuggcccgacggggccgaccugaaccugaugcccaucuga

SEQ ID NO: 28301 - RNA, 1410 nt, Artificial Sequence; identical to SEQ ID NO: 27767
  derived and/or modified CDS sequence (AUadapt) from InfluenzaA__AJJ99115__NA

SEQ ID NO: 28302 - RNA, 1410 nt, Artificial Sequence; identical to SEQ ID NO: 26687
  derived and/or modified CDS sequence (AUadapt) from InfluenzaA__AJJ99127__NA

SEQ ID NO: 28303 - RNA, 1410 nt, Artificial Sequence; identical to SEQ ID NO: 27975
  derived and/or modified CDS sequence (AUadapt) from InfluenzaA__AJJ99139__NA

SEQ ID NO: 28304 - RNA, 1410 nt, Artificial Sequence
  derived and/or modified CDS sequence (AUadapt) from InfluenzaA__AJJ99151__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggagcgcgcagcacguggaggagugcuccugcuacccccgguacccgggcguccgcugcgugugccgggacaacuggaaggggucgaaccgccccaucguggacaucaacaucaaggaccacuccaucgucagcuccuacgugugcucgggccuggugggcgacacgccccggaagaacgacuccagcuccucgucccacugccuggaccccaacaacgaggagggcgggcacggggucaagggcugggccuucgacgacgggaacgacguguggaugggccgcaccaucagcgagaagucccggcucggcuacgagaccuucaaggucaucgagggguggucgaacccgaaguccaagcugcagaucaaccgccaggugaucguggaccggggcaaccgcagcggguacuccggcaucuucucggucgagggcaagagcugcaucaaccggugcuucuacguggagcugauccgcgggcggaaggaggagaccgaggugcucuggaccuccaacucgaucgucguguucugcggcaccuccgggacguacggcaccgggagcuggcccgacggcgccgacaucaaccugaugcccaucuga

SEQ ID NO: 28305 - RNA, 1410 nt, Artificial Sequence; identical to SEQ ID NO: 19001
  derived and/or modified CDS sequence (AUadapt) from InfluenzaA__AJJ99163__NA

SEQ ID NO: 28306 - RNA, 1410 nt, Artificial Sequence
  derived and/or modified CDS sequence (AUadapt) from InfluenzaA__AJJ99175__NA
augaaccccaaccagaagaucaucaccaucggcucggugucccugaccaucucgacgaucugccucuucaugcagaucgccauccugaucaccaccgucacccugcacuucaagcaguacgaguucaacuccccgcccaacaaccaggugaugcucugcgagcccacgaucaucgagcgcaacaucaccgagaucguguaccugaccaacaccacgaucgagaaggagaucugccccaagcuggccgaguaccggaacuggagcaagccgcagugcgacaucaccggguucgcgcccuucuccaaggacaacucgauccgccucuccgccggcggggacaucugggucacccgggagcccuacgugagcugcgaccccgacaagugcuaccaguucgcccugggccaggggaccacgcugaacaacgugcacuccaacaacaccguccgcgaccggaccccguaccgcacccuccugaugaacgagcugggcgugcccuuccaccucggcacgaagcaggucugcaucgccuggucguccagcuccugccacgacgggaaggccuggcugcacgugugcaucaccggcgacgacaagaacgcgaccgccucguucaucuacaacgggcggcugguggacuccguggucagcugguccaaggagauccuccgcacccaggagucggagugcgugugcaucaacggcacgugcaccguggucaugaccgacggguccgccagcggcaaggccgacaccaagauccuguucaucgaggagggcaagaucgugcacacgucgacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccucgugggcgacacgccccggaagaacgacuccagcuccucgucccacugccuggaccccaacaacgaggagggcgggcacggggucaagggcugggccuucgacgacgggaacgacguguggaugggccgcaccaucagcgagaagucccggcugggcuacgagaccuucaaggucaucgagggguggucgaaccccaaguccaagcuccagaucaaccgccaggugaucguggaccggggcaaccgcagcggguacuccggcaucuucucggucgagggcaagagcugcaucaaccggugcuucuacguggagcugauccgcgggcggaaggaggagaccgaggugcuguggaccuccaacucgaucgucguguucugcggcaccuccgggacguacggcaccgggagcuggccggacggcaccgacaucaaccucaugcccaucuga

SEQ ID NO: 28307 - RNA, 1410 nt, Artificial Sequence
  derived and/or modified CDS sequence (AUadapt) from InfluenzaA__AJJ99199__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcaaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggucaucguggaccggggcaaccgcucgggguacuccggcaucuucagcguggagggcaagucgugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 28308 - RNA, 1410 nt, Artificial Sequence; identical to SEQ ID NO: 19145
  derived and/or modified CDS sequence (AUadapt) from InfluenzaA__AJJ99211__NA

SEQ ID NO: 28309 - RNA, 1410 nt, Artificial Sequence
  derived and/or modified CDS sequence (AUadapt) from InfluenzaA__AJJ99223__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcaaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcgaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucugggugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 28310 - RNA, 1410 nt, Artificial Sequence
  derived and/or modified CDS sequence (AUadapt) from InfluenzaA__AJJ99235__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacgacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccaucgugagcugguccaaggagauccugcgcacccaggagucggagugcgucugcaucaacggcacgugcaccguggugaugaccgacggguccgccagcggcgaggccgacaccaagauccuguucaucgaggagggcaagaucguccacacgucgacccucuccgggagcgcgcagcacguggaggagugcuccugcuacccccgguacccgggcgugcgcugcgucugccgggacaacuggaaggggucgaaccgccccaucguggacaucaacaucaaggaccacuccaucgugagcuccuacgucugcucgggccuggugggcgacacgccccggaagaacgacuccagcuccucgucccacugccuggaccccaacaacgaggagggcgggcacggggugaagggcugggccuucgacgacgggaacgacgucuggaugggccgcaccaucagcgagaagucccggcucggcuacgagaccuucaaggugaucgagggguggucgaacccgaaguccaagcugcagaucaaccgccaggucaucguggaccggggcaaccgcagcggguacuccggcaucuucucgguggagggcaagagcugcaucaaccggugcuucuacgucgagcugauccgcgggcggaaggaggagaccgaggugcucuggaccuccaacucgaucguggucuucugcggcaccuccgggacguacggcaccgggagcuggcccgacggcgccgacaucaaccugaugcccaucuga

SEQ ID NO: 28311 - RNA, 1410 nt, Artificial Sequence
  derived and/or modified CDS sequence (AUadapt) from InfluenzaA__AJJ99246__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccagaacgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacagcaacgggaccaucaaggaccggucccccuaccgcacgcugaugagcugcccgaucggcgaggugcccucccccuacaacucgcgguucgagagcguggccugguccgcgagcgccugccacgacgggaucaacuggcucaccaucggcaucuccggccccgacagcggggccgucgccgugcugaaguacaacggcaucaucaccgacaccaucaaguccuggcgcaacaacauccugcggacgcaggagagcgagugcgcgugccucaacggguccugcuucaccaucaugaccgacggcccgagcgacggccaggccuccuacaagaucuuccgcaucgagaaggggaagaucgugaaguccgucgagaugaacgcccccaacuaccacuacgaggagugcuccugcuaccccgacucguccgagaucacgugcgugugccgggacaacuggcacggcagcaaccgccccuggguguccuucaaccagaaccuggaguaccagaucggguacaucugcagcggcaucuucggggacaacccgcggcccaacgacaagaccggcuccugcggccccgucagcuccagcggggccaacggcgugaagggguucagcuucaaguacggcaacgggguguggaucggccgcaccaaguccaucucgucccggaagggcuucgagaugaucugggaccccaacggguggaccggcaccgacaacaacuucagcaucaagcaggacaucgucgggaucaacgagugguccggcuacagcggguccuucgugcagcacccggagcugacgggccucgacugcauccgccccugcuucuggguggagcugauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 28312 - RNA, 1410 nt, Artificial Sequence
  derived and/or modified CDS sequence (AUadapt) from InfluenzaA__AJJ99257__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccguccccuccaacggggccaacggcgugaagggguucucguucaaguacggcaacgggguguggaucggccgcaccaaguccaucagcagccggaagggcuucgagaugaucugggacccgaacggguggaccggcaccgacaacuccuucagcaucaagcaggacaucgucgggacgaacgagugguccggcuacucgggguccuucgugcagcaccccgagcugaccggccuggacugcauccgccccugcuucuggguggagcucauccggggccgccccaaggagaacaccaucuggaccagcggguccagcaucuccuucugcggcgucaacagcgggacggugggcugguccuggccggacggcgccgagcugcccuucaccaucgacaaguga

SEQ ID NO: 28313 - RNA, 1413 nt, Artificial Sequence; identical to SEQ ID NO: 19034
  derived and/or modified CDS sequence (AUadapt) from InfluenzaA__AJJ99269__NA

SEQ ID NO: 28314 - RNA, 1410 nt, Artificial Sequence; identical to SEQ ID NO: 23360
  derived and/or modified CDS sequence (AUadapt) from InfluenzaA__AJJ99280__NA

SEQ ID NO: 28315 - RNA, 1410 nt, Artificial Sequence; identical to SEQ ID NO: 23111
  derived and/or modified CDS sequence (AUadapt) from InfluenzaA__AJJ99291__NA

SEQ ID NO: 28316 - RNA, 1413 nt, Artificial Sequence
  derived and/or modified CDS sequence (AUadapt) from InfluenzaA__AJJ99303__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccucgaacaaggccgccuccuacaagaucuucaagaucgagaaggggaaggugaccaagagcauggagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcucgggcgucuucggggacaacccccggcccgaggacggcgagggguccugcaacccggugaccguggacggcgcgaacggggucaagggcuucagcuacaaguacgacaacggcguguggaucgggcgcacgaaguccaaccggcugcgcaagggcuucgagaugaucugggaccccaacggguggaccaacaccgacucggacuucuccgugaagcaggacgucguggccaucaccgacuggagcggcuacagcggguccuucgugcagcaccccgagcucacgggccuggacugcauccggcccugcuucugggucgagcuggugcgcggccucccgcgggagaacaccaccaucuggaccucgggguccagcaucuccuucugcggcgucaacagcgacacggccaacugguccuggcccgacggggccgagcugcccuucaccaucgacaaguga

SEQ ID NO: 28317 - RNA, 1410 nt, Artificial Sequence
  derived and/or modified CDS sequence (AUadapt) from InfluenzaA__AJJ99314__NA
augaaccccaaccagaagaucaucaccaucggcucggccugcaugaccaucgggauggccaaccugauccuccagaucggcaacaucaucuccaucuggaucagccacuccauccagcuggggaaccagaaccagaucgagacgugcaaccagagcgugaucaccuacgagaacaacaccugggucaaccagaccuacgugaacaucuccaacacgaacuucgcggccggccagagcguggucuccgugaagcuggccgggaacucgucccucugcccggugagcggcugggccaucuacuccaaggacaacagcauccgcaucggcuccaagggggacgucuucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgcgugguccgccucggccugccacgacgggaucaacuggcucaccaucggcaucuccggccccgacaacggggccguggcggugcugaaguacaacggcaucaucaccgacaccaucaagagcuggcgcaacaacauccugcggacgcaggaguccgagugcgccugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccucgaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacucgggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgcggagcugccguucacgaucgacaaguga

SEQ ID NO: 28318 - RNA, 1413 nt, Artificial Sequence
  derived and/or modified CDS sequence (AUadapt) from InfluenzaA__AJJ99326__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccagcccguacaacucgaaguucgaguccguggccuggagcgccuccgccugccacgacggccucggcuggcugaccaucgggaucagcggccccgacaacggggcgguggccguccugaaguacaacggcaucaucacgggcaccaucaaguccuggaagaagcagauccuccgcacccaggagucggagugcgugugcaugaacggguccugcuucaccaucaugacggacggccccagcaacaaggccgccuccuacaagaucuucaagaucgagaaggggaaggugaccaagagcaucgagcugaacgcccccaacuucuacuacgaggagugcuccugcuacccggacaccggcaucgucaugugcgugugccgggacaacuggcacgggucgaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcuccgcaagggguucgagaugaucugggaccccaacggcuggaccaacaccgacucggacuucuccgugaagcaggacgucguggccaucaccgacuggagcggguacagcggcuccuucgugcagcaccccgagcugacgggccuggacugcauccggcccugcuucugggucgagcucgugcgcgggcugccgcgggagaacaccaccaucuggaccucgggcuccagcaucuccuucugcggggucaacagcgacacggccaacugguccuggcccgacggcgccgagcugcccuucaccaucgacaaguga

SEQ ID NO: 28319 - RNA, 1410 nt, Artificial Sequence; identical to SEQ ID NO: 20784
  derived and/or modified CDS sequence (AUadapt) from InfluenzaA__AJJ99337__NA

SEQ ID NO: 28320 - RNA, 1410 nt, Artificial Sequence; identical to SEQ ID NO: 20247
  derived and/or modified CDS sequence (AUadapt) from InfluenzaA__AJJ99348__NA

SEQ ID NO: 28321 - RNA, 1410 nt, Artificial Sequence; identical to SEQ ID NO: 16318
  derived and/or modified CDS sequence (AUadapt) from InfluenzaA__AJJ99359__NA

SEQ ID NO: 28322 - RNA, 1410 nt, Artificial Sequence
  derived and/or modified CDS sequence (AUadapt) from InfluenzaA__AJJ99370__NA
augaaccccaaccagaagaucaucaccaucggcucggugugcaugaucaucgggauggccaaccugauccuccagaucggcaacaucaucuccaucuggaucagccacuccauccagcuggggaaccagagccagaucgagaccugcaaccaguccgucaucacguacgagaacaacaccugggugaaccagaccuacgugaacaucagcaacaccaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcacguucuuccugacccagggcgcccuccugaacgacaagcacuccaacgggaccaucaaggaccggucgccccaccgcacccugauguccugcccgaucggcgagguccccagccccuacaacagccgguucgaguccguggccuggagcgcguccgccugccacgacgggaucaacuggcucacgaucggcaucagcggccccgacaacggggccguggccguccugaaguacaacggcaucaucaccgacaccaucaaguccuggcgcaacaacauccugcggacccaggagucggagugcgcgugcgugaacggguccugcuucacgaucaugaccgacggcccgagcgaccgccaggccuccuacaagaucuuccggaucgagaagggcaagaucgucaagagcguggagaugaacgcccccaacuaccacuacgaggagugcuccugcuaccccgacagcuccgagaucacgugcgugugccgcgacaacuggcacgggagcaaccggcccuggguguccuucaaccagaaccucgaguaccagaucggcuacaucugcucggggaucuucggcgacaacccgcgccccaacgacaagaccggguccugcggccccgucagcuccaacggcgccaacggggugaagggcuucagcuucaaguacgggaacggcguguggaucgggcggaccaagagcaucuccagccgcaagggcuucgagaugaucugggaccccaacggcuggaccgggaccgacaacaacuucuccaucaagcaggacaucgucggcaucaacgaguggucgggguacuccggcagcuucgugcagcacccggagcugaccgggcuggacugcauccggcccugcuucuggguggagcucauccgcggccggcccaaggagaacacgaucuggaccuccggcagcuccaucagcuucugcggggucaacuccgacaccgugggcuggagcuggcccgacggggccgagcugccguucaccaucgacaaguga

SEQ ID NO: 28323 - RNA, 1410 nt, Artificial Sequence; identical to SEQ ID NO: 22659
  derived and/or modified CDS sequence (AUadapt) from InfluenzaA__AJJ99381__NA

SEQ ID NO: 28324 - RNA, 1410 nt, Artificial Sequence
  derived and/or modified CDS sequence (AUadapt) from InfluenzaA__AJJ99392__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccgugucccccaacggggccaacggcgugaagggguucucguucaaguacggcaacggggucuggaucggccgcaccaaguccaucagcagccggaacggcuucgagaugaucugggacccgaacggguggaccggcaccgacaacaacuucuccaucaagcaggacaucguggggaucaacgaguggagcggcuacuccgggucguucgugcagcaccccgagcugacgggccuggacugcauccgccccugcuucugggucgagcucauccggggccgccccaaggagaacaccaucuggaccuccgggagcuccaucagcuucugcggcgugaacuccgacaccgucggguggagcuggccggacggcgccaagcugcccuucacgaucgacaaguga

SEQ ID NO: 28325 - RNA, 1410 nt, Artificial Sequence; identical to SEQ ID NO: 16318
  derived and/or modified CDS sequence (AUadapt) from InfluenzaA__AJJ99403__NA

SEQ ID NO: 28326 - RNA, 1413 nt, Artificial Sequence; identical to SEQ ID NO: 19863
  derived and/or modified CDS sequence (AUadapt) from InfluenzaA__AJJ99415__NA

SEQ ID NO: 28327 - RNA, 1413 nt, Artificial Sequence
  derived and/or modified CDS sequence (AUadapt) from InfluenzaA__AJJ99427__NA
augaaccccaaccagaagaucaucaccaucggcucgaucuccaucgccaucgggaucaucagccugaugcuccagaucggcaacaucaucuccaucugggccagccacuccauccagaccgggucgcagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucucgggcugggccguguacaccaaggacaacuccauccggaucgggagcaagggcgacguguucgucauccgcgagccguucaucuccugcagccaccucgagugccggacguucuuccugacccagggggcccugcucaacgacaagcacuccaacggcaccgugaaggaccgcucgcccuaccgggcccugauguccugcccccugggggaggcgcccagcccguacaacagcaaguucgaguccguggccuggagcgccuccgccugccacgacggcaugggcuggcucaccaucgggaucucgggccccgacaacggggcggucgccgugcugaaguacaacggcaucaucacgggcaccaucaaguccuggaagaagcagauccugcgcacccaggagagcgagugcgugugcaugaacggguccugcuucaccaucaugacggacggccccagcgacaaggccgccuccuacaagaucuucaagaucgagaaggggaaggucaccaagucgaucgagcucaacgcccccaacuucuacuacgaggagugcuccugcuacccggacaccggcaucgugaugugcgugugccgggacaacuggcacgggagcaaccgccccugggucuccuucaaccagaaccuggacuaccagaucggcuacaucugcagcggcguguucggggacaacccccggcccgaggacggcgagggguccugcaacccggugaccgucgacggcgcgaacggggugaagggcuucucguacaaguacggcaacgggguguggaucggccgcacgaaguccaaccggcugcgcaagggguucgagaugaucugggaccccaacggcuggaucaacaccgacagcgacuucuccgucaagcaggacgugguggccaucaccgacuggagcggguacucgggcuccuucguccagcaccccgagcucaccggccuggacugcauccggcccugcuucuggguggagcugguccgcgggcucccgcgggagaacacgaccaucuggaccagcggcuccagcaucuccuucugcggggugaacagcgacaccgccaacugguccuggcccgacggcgccgagcugcccuucacgaucgacaaguga

SEQ ID NO: 28328 - RNA, 1413 nt, Artificial Sequence
  derived and/or modified CDS sequence (AUadapt) from InfluenzaA__AJJ99439__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaccagcggcugggccaucuacacgaaggacaacuccauccggaucgggucgaagggcgacguguucgugauccgcgagccguucaucuccugcagccaccucgagugccggaccuucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucacgaucgggaucucgggccccgacaacggggcgguggccguccugaaguacaacggcaucaucaccggcaccaucaaguccuggaagaagcagauccugcgcacccaggagagcgagugcgugugcaugaacggguccugcuucacgaucaugaccgacggccccucgaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcucgggcgucuucggggacaacccccggcccgaggacggcgagggguccugcaacccggugacgguggacggcgcgaacggggucaagggcuucagcuacaaguacggcaacgggguguggaucggccgcaccaaguccaaccggcugcgcaagggguucgagaugaucugggaccccaacggcuggaccaacaccgacucggacuucuccgugaagcaggacgucguggccaucacggacuggagcggguacagcggcuccuucgugcagcaccccgagcucaccggccuggacugcauccggcccugcuucugggucgagcuggugcgcgggcucccgcgggagaacaccaccaucuggacgucgggcuccagcaucuccuucugcggggucaacagcgacaccgccaacugguccuggcccgacggcgccgagcugcccuucaccaucgacaaguga

SEQ ID NO: 28329 - RNA, 1413 nt, Artificial Sequence
  derived and/or modified CDS sequence (AUadapt) from InfluenzaA__AJJ99451__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaaccgcaccgucaaggaccggagccccuaccgcgcccugauguccugcccccugggcgaggcgcccucgccguacaacagcaaguucgaguccguggccuggagcgccuccgccugccacgacgggaugggcuggcucaccaucggcaucucggggcccgacaacggcgcgguggccguccugaaguacaacgggaucaucacgggcaccaucaaguccuggaagaagcagauccugcggacccaggagagcgagugcgugugcaugaacggcuccugcuucaccaucaugacggacgggcccucgaacaaggccgccuccuacaagaucuucaagaucgagaagggcaaggugaccaagagcaucgagcucaacgcccccaacuuccacuacgaggagugcuccugcuacccggacaccgggaucgucaugugcgugugccgcgacaacuggcacggcagcaaccggcccuggguguccuucaaccagaaccuggacuaccagaucggguacaucugcucgggcgucuucggcgacaacccccgccccgaggacggggagggcuccugcaacccggugaccguggacggggcgaacggcgucaagggguucagcuacaaguacgacaacggcguguggaucggccggacgaaguccaaccgccugcggaagggguucgagaugaucugggaccccaacggcuggaccaacaccgacucggacuucuccgugaagcaggacgucguggccaucaccgacuggagcggguacagcggcuccuucgugcagcaccccgagcucacggggcuggacugcauccgccccugcuucugggucgagcuggugcggggccucccgcgcgagaacaccaccaucuggaccucgggcuccagcaucuccuucugcggggucaacagcgacacggccaacugguccuggcccgacggcgccgagcugcccuucaccaucgacaaguga

SEQ ID NO: 28330 - RNA, 1413 nt, Artificial Sequence; identical to SEQ ID NO: 19034
  derived and/or modified CDS sequence (AUadapt) from InfluenzaA__AJJ99463__NA

SEQ ID NO: 28331 - RNA, 1410 nt, Artificial Sequence
  derived and/or modified CDS sequence (AUadapt) from InfluenzaA__AJJ99474__NA
augaaccccaaccagaagaucaucaccaucggcucggugugcaugaccaucgggaucgccaaccugauccuccagaucggcaacaucaucuccaucuggaucagccacuccauccagcuggggaaccagaaccagaucgagacgugcaaccagagcgucaucaucuacgagaacaacaccugggugaaccagaccuacgugaacaucuccaacaccaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagucgguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacgaucaugaccgacggcccguccgacggccaggccagcuacaagaucuuccgcaucgagaaggggaagaucaucaaguccguggagaugaacgcccccaacuaccacuacgaggagugcagcugcuaccccgacuccucggagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaagggcuucgagaugaucugggaccccaacggguggaccggcaccgacaacucguucuccaucaagcaggacaucguggggaucaacgaguggagcggcuacuccgggagcuucguccagcacccggagcugaccggccuggacugcauccgccccugcuucuggguggagcucauccggggccgccccaaggagaacacgaucuggaccuccgggagcuccaucagcuucugcggcgugaacuccgggaccgucggcuggagcuggcccgacggcgccgagcugccguucaccaucgacaaguga

SEQ ID NO: 28332 - RNA, 1410 nt, Artificial Sequence; identical to SEQ ID NO: 23111
  derived and/or modified CDS sequence (AUadapt) from InfluenzaA__AJJ99496__NA

SEQ ID NO: 28333 - RNA, 1410 nt, Artificial Sequence
  derived and/or modified CDS sequence (AUadapt) from InfluenzaA__AJJ99507__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcgccaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucucguucaaguacgacaacggcgucuggaucgggcgcaccaaguccaucagcagccggaacggcuucgagaugaucugggaccccaacggcuggaccgggaccgacaacgacuucuccaucaagcaggacaucgugggcaucaacgaguggagcggguacuccggcucguucgugcagcacccggagcugacggggcuggacugcauccgccccugcuucugggucgagcucauccggggccgccccaaggagaacaccaucuggaccuccggcagcuccaucagcuucugcggggugaacuccgacaccgucggcuggagcuggcccgacggggcggagcugccguucacgaucgacaaguga

SEQ ID NO: 28334 - RNA, 1410 nt, Artificial Sequence; identical to SEQ ID NO: 16318
  derived and/or modified CDS sequence (AUadapt) from InfluenzaA__AJJ99518__NA

SEQ ID NO: 28335 - RNA, 1410 nt, Artificial Sequence
  derived and/or modified CDS sequence (AUadapt) from InfluenzaA__AJJ99529__NA
augaaccccaaccagaagaucaucaccaucggcucggugugcaugaccaucgggauggccaaccugauccuccaggucggcaacaucaucuccaucuggaucagccacuccauccagcuggggaaccagaaccagaucgagacgugcaaccagagcgugaucaccuacgagaacaacaccugggugaaccagaccuacgucaacaucuccaacacgaacuucgccgcgggccagagcgugguguccgucaagcuggccgggaacagcucccucugcccggugucgggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagucgguggccugguccgcgagcgccugccacgacggguucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucaucaaguccgucgagaugaacgcccccaacuaccacuacgaggagugcagcugcuaccccgacuccucggagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacucguucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgggaccgugggcuggagcuggcccgacggcgccgagcugccguucacgaucgacaaguga

SEQ ID NO: 28336 - RNA, 1410 nt, Artificial Sequence
  derived and/or modified CDS sequence (AUadapt) from InfluenzaA__AJJ99540__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcaagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggaucuggaucggccgcaccaagagcaucagcucccggaagggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 28337 - RNA, 1410 nt, Artificial Sequence
  derived and/or modified CDS sequence (AUadapt) from InfluenzaA__AJJ99551__NA
augaaccccaaccagaagaucaucaccaucggcucggugugcaugaccaucgggauggccaaccugauccuccagaucggcaacaucaucuccaucuggaucagccacuccauccagcuggggaaccagagccagacggagaccugcaaccaguccgucaucaccuacgagaacaacaccugggugaaccagacguacgugaacaucucgaacaccaacccggccgcgggccaguccgucgugagcgugaagcuggccgggaacuccagccucugccccgucuccggcugggccaucuacagcaaggacaacuccauccgcaucggcucgaagggggacguguucgugauccgggagcccuucaucuccugcagcucccuggagugccgcaccuucuuccugacccagggcgcccuccugaacgacaagcacagcaacgggacgaucaaggaccggucccccuaccgcacccugaugucgugcccgaucggcgagguccccagccccuacaacucccgguucgagagcguggccugguccgcgagcgccugccacgacgggaucaacuggcucaccaucggcaucuccggccccgacaacggggccguggccguccugaaguacaacggcaucaucaccgacacgaucaagucguggcgcaacaacauccugcggacccaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccucggagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccucgaacggggccaacggcgugaagggguucagcuucaaguacggcaacgggguguggaucggccgcaccaaguccaucagcucccggaagggcuucgagaugaucugggaccccaacggguggaccggcacggacaacaacuucagcaucaagcaggacaucgucgggaucaacgagugguccggcuacucgggguccuucgugcagcacccggagcugaccggccuggacugcauccgccccugcuucuggguggagcucauccggggccgccccaaggagaacaccaucuggaccagcggguccagcaucuccuucugcggcgucaacagcgacacgguggggugguccuggcccgacggcgccgagcugccguucaccaucgacaaguga

SEQ ID NO: 28338 - RNA, 1410 nt, Artificial Sequence; identical to SEQ ID NO: 23127
  derived and/or modified CDS sequence (AUadapt) from InfluenzaA__AJJ99562__NA

SEQ ID NO: 28339 - RNA, 1410 nt, Artificial Sequence
  derived and/or modified CDS sequence (AUadapt) from InfluenzaA__AJJ99573__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcucgggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacgucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 28340 - RNA, 1410 nt, Artificial Sequence; identical to SEQ ID NO: 28317
  derived and/or modified CDS sequence (AUadapt) from InfluenzaA__AJJ99584__NA

SEQ ID NO: 28341 - RNA, 1410 nt, Artificial Sequence
  derived and/or modified CDS sequence (AUadapt) from InfluenzaA__AJJ99595__NA
augaaccccaaccagaagaucaucaccaucggcucggugugcaugaccaucgggauggccaaccugaucuuccagaucggcaacaucaucuccaucuggaucagccacuccauccagcucgggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccugugcccggucucgggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcucacgggccuggacugcauccgccccugcuucugggucgagcugauccggggccgccccaaggagaacaccaucuggaccagcggguccagcaucuccuucugcggcgugaacagcgacaccgucgggugguccuggcccgacggcgccgagcucccguucacgaucgacaaguga

SEQ ID NO: 28342 - RNA, 1410 nt, Artificial Sequence
  derived and/or modified CDS sequence (AUadapt) from InfluenzaA__AJJ99606__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcgugaucaccgacaccaucaagagcuggcgcaacaacauccugcggacgcaggaguccgagugcgcgugcgugaacgggucgugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 28343 - RNA, 1413 nt, Artificial Sequence; identical to SEQ ID NO: 19863
  derived and/or modified CDS sequence (AUadapt) from InfluenzaA__AJJ99618__NA

SEQ ID NO: 28344 - RNA, 1413 nt, Artificial Sequence
  derived and/or modified CDS sequence (AUadapt) from InfluenzaA__AJJ99630__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagucggagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggucgaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacucggacuucuccaugaagcagaacguggucgccaucaccgacuggagcggguacagcggcuccuucgugcagcaccccgagcucacgggccuggacugcauccggcccugcuucuggguggagcugguccgcgggcucccgcgggagaacaccaccaucuggaccucgggcuccagcaucuccuucugcggggugaacagcgacacggccaacugguccuggcccgacggcgccgagcugcccuucaccaucgacaaguga

SEQ ID NO: 28345 - RNA, 1413 nt, Artificial Sequence; identical to SEQ ID NO: 19863
  derived and/or modified CDS sequence (AUadapt) from InfluenzaA__AJJ99642__NA

SEQ ID NO: 28346 - RNA, 1413 nt, Artificial Sequence; identical to SEQ ID NO: 19863
  derived and/or modified CDS sequence (AUadapt) from InfluenzaA__AJJ99654__NA

SEQ ID NO: 28347 - RNA, 1413 nt, Artificial Sequence
  derived and/or modified CDS sequence (AUadapt) from InfluenzaA__AJJ99666__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacaacaacgugguggcgggggaggacaagacgagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggaccuucuuccugacgcagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucaccggcacgaucaaguccuggaagaagcagauccugcgcacccaggagagcgagugcgugugcaugaacggguccugcuucaccaucaugaccgacggccccucgaacaaggccgccuccuacaagaucuucaagaucgagaaggggaaggugaccaagagcaucgagcucaacgcccccaacuuccacuacgaggagugcuccugcuacccggacacgggcaucgucaugugcgugugccgggacaacuggcacgggagcaaccgccccuggguguccuucaaccagaaccuggacuaccagaucggcuacaucugcucgggcgucuucggggacaacccccggcccgaggacggcgagggguccugcaacccggugaccguggacggcgcgaacggggucaagggcuucagcuacaaguacgacaacggcguguggaucgggcgcaccaaguccaaccggcugcgcaagggcuucgagaugaucugggaccccaacggguggacgaacaccgacucggacuucuccgugaagcaggacgucguggccaucaccgacuggagcggcuacagcggguccuucgugcagcaccccgagcucaccggccuggacugcauccggcccugcuucugggucgagcuggugcgcggccucccgcgggagaacacgaccaucuggaccucgggguccagcaucuccuucugcggcgucaacagcgacaccgccaacugguccuggcccgacggggccgagcugcccuucacgaucgacaaguga

SEQ ID NO: 28348 - RNA, 1410 nt, Artificial Sequence
  derived and/or modified CDS sequence (AUadapt) from InfluenzaA__AJJ99677__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccaucaugaccgacggcccguccgacggccaggccagcuacaagaucuuccgcaucgagaaggggaagaucaucaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcucgugcggccccguguccagcaacggggccaacggcgucaagggguucuccuucaaguacggcaacgggguguggaucggccgcaccaagagcaucagcucccggaagggcuucgagaugaucugggaccccaacggguggaccggcaccgacaacagcuucuccaucaagcaggacaucguggggaugaacgaguggucgggcuacuccgggagcuucguccagcacccggagcugacgggccuggacugcauccgccccugcuucuggguggagcucauccggggccgccccaaggagaacaccaucuggaccuccgggagcuccaucagcuucugcggcgugaacuccgggaccgucggcuggagcuggcccgacggcgccgagcugccguucacgaucgacaaguga

SEQ ID NO: 28349 - RNA, 1410 nt, Artificial Sequence
  derived and/or modified CDS sequence (AUadapt) from InfluenzaA__AJJ99688__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccaucaugaccgacggcccguccgacggccaggccagcuacaagaucuuccgcaucgagaaggggaagaucaucaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcucgugcggccccguguccagcaacggggccaacggcgucaagggguucuccuucaaguacggcaacgggguguggaucggccgcaccaagagcaucagcucccggaagggcuucgagaugaucugggaccccaacggguggaccggcaccgacaacagcuucuccaucaagcaggacaucguggggaucaacgaguggucgggcuacuccgggagcuucguccagcacccggagcugacgggccuggacugcauccgccccugcuucuggguggagcucauccggggccgccccaaggagaacaccaucuggaccuccgggagcuccaucagcuucugcggcgugaacuccgggaccgucggcuggagcuggcccgacggcgccgagcugccguucacgaucgacaaguga

SEQ ID NO: 28350 - RNA, 1410 nt, Artificial Sequence
  derived and/or modified CDS sequence (AUadapt) from InfluenzaA__AJJ99710__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccaagaucacgugcgugugccgggacaacuggcacggcagcaaccgccccuggguguccuucaaccagaaccucgaguaccagaucggguacaucugcucgggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggucgggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 28351 - RNA, 1410 nt, Artificial Sequence; identical to SEQ ID NO: 22659
  derived and/or modified CDS sequence (AUadapt) from InfluenzaA__AJJ99721__NA

SEQ ID NO: 28352 - RNA, 1410 nt, Artificial Sequence; identical to SEQ ID NO: 22659
  derived and/or modified CDS sequence (AUadapt) from InfluenzaA__AJJ99732__NA

SEQ ID NO: 28353 - RNA, 1410 nt, Artificial Sequence; identical to SEQ ID NO: 23359
  derived and/or modified CDS sequence (AUadapt) from InfluenzaA__AJJ99743__NA

SEQ ID NO: 28354 - RNA, 1410 nt, Artificial Sequence; identical to SEQ ID NO: 20693
  derived and/or modified CDS sequence (AUadapt) from InfluenzaA__AJJ99754__NA

SEQ ID NO: 28355 - RNA, 1410 nt, Artificial Sequence
  derived and/or modified CDS sequence (AUadapt) from InfluenzaA__AJJ99765__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccaccggccagagcgucguguccgugaagcuggcggggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggacgaucaaggaccggucccccuaccgcacccugaugucgugcccgaucggcgagguccccucccccuacaacagccgguucgagagcguggccugguccgccagcgcgugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgccugcgugaacgggucgugcuucaccgugaugaccgacggcccguccgacggccaggcgagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcacggacaacaacuucucgaucaagcaggacaucguggggaucaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 28356 - RNA, 1413 nt, Artificial Sequence
  derived and/or modified CDS sequence (AUadapt) from InfluenzaA__AJJ99777__NA
augaaccccaaccagaagaucaucaccaucggcucgaucuccaucgccaucgggaucaucagccugauccuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagucggagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggucgaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacucggacuucuccgugaagcaggacgucguggccaucaccgacuggagcggguacagcggcuccuucgugcagcaccccgagcucacgggccuggacugcauccggcccugcuucugggucgagcuggugcgcgggcucccgcgggagaacaccgccgucuggaccucgggcuccagcaucuccuucugcggggugaacagcgacaccgccaacugguccuggcccgacggcgccgagcugcccuucacgaucgacaaguga

SEQ ID NO: 28357 - RNA, 1410 nt, Artificial Sequence; identical to SEQ ID NO: 16318
  derived and/or modified CDS sequence (AUadapt) from InfluenzaA__AJJ99788__NA

SEQ ID NO: 28358 - RNA, 1413 nt, Artificial Sequence
  derived and/or modified CDS sequence (AUadapt) from InfluenzaA__AJJ99800__NA
augaaccccaaccagaagaucaucaccaucggcucgaucuccaucgccaucgggaucaucagccugaugcuccagaucggcaacaucaucuccaucugggccagccacuccauccagaccgggucgcagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucucgggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagucgaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucucguacaaguacggcaacgggguguggaucggccgcacgaaguccaaccggcugcgcaagggguucgagaugaucugggaccccaacggcuggaccaacaccgacagcgacuucuccgugaagcaggacgucguggccaucaccgacuggagcggguacucgggcuccuucgugcagcaccccgagcucacgggccuggacugcauccggcccugcuucugggucgagcuggugcgcgggcucccgcgggagaacaccaccaucuggaccagcggcuccagcaucuccuucugcggggucaacagcgacacggccaacugguccuggcccgacggcgccgagcugcccuucaucaucgacaaguga

SEQ ID NO: 28359 - RNA, 1413 nt, Artificial Sequence; identical to SEQ ID NO: 19863
  derived and/or modified CDS sequence (AUadapt) from InfluenzaA__AJJ99812__NA

SEQ ID NO: 28360 - RNA, 1413 nt, Artificial Sequence
  derived and/or modified CDS sequence (AUadapt) from InfluenzaA__AJJ99824__NA
augaaccccaaccagaagaucaucaccaucggcucgaucuccaucgccaucgggaccaucagccugaugcuccagaucggcaacaucaucuccaucugggccucgcacuccauccagacggggagccagaacaacaccggcaucugcaaccagcgcaucaucaccuacgagaacuccaccugggugaaccacacguacgucaacaucaacaacaccaacgugguggcgggggaggacaagaccucggucacccuggccggcaacuccagccugugcuccaucagcggcugggccaucuacacgaaggacaacuccauccggaucgggucgaagggcgacguguucgugauccgcgagccguucaucuccugcagccaccucgagugccggaccuucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucacgaucgggaucagcggccccgacaacggggcgguggccguccugaaguacaacggcaucaucaccggcaccaucaaguccuggaagaagcagauccugcgcacccaggagucggagugcgugugcaugaacggguccugcuucacgaucaugaccgacggccccagcaacaaggccgccuccuacaagaucuucaagaucgagaaggggaaggugaccaagucgaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcucgggcgucuucggggacaacccccggcccgaggacggcgagggguccugcaacccggugacgguggacggcgcgaacggggucaagggcuucagcuacaaguacgacaacggcguguggaucgggcgcaccaaguccaaccggcugcgcaagggcuucgagaugaucugggaccccaacggguggaccaacaccgacagcgacuucuccgugaagcaggacgucguggccaucacggacuggucgggcuacagcggguccuucgugcagcaccccgagcucaccggccuggacugcauccggcccugcuucugggucgagcuggugcgcggccucccgcgggagaacaccaccaucuggacgucgggguccagcaucuccuucugcggcgucaacagcgacaccgccaacugguccuggcccgacggggccgagcugcccuucaccaucgacaaguga

SEQ ID NO: 28361 - RNA, 1410 nt, Artificial Sequence; identical to SEQ ID NO: 28349
  derived and/or modified CDS sequence (AUadapt) from InfluenzaA__AJJ99835__NA

SEQ ID NO: 28362 - RNA, 1410 nt, Artificial Sequence; identical to SEQ ID NO: 22659
  derived and/or modified CDS sequence (AUadapt) from InfluenzaA__AJJ99846__NA

SEQ ID NO: 28363 - RNA, 1410 nt, Artificial Sequence; identical to SEQ ID NO: 22659
  derived and/or modified CDS sequence (AUadapt) from InfluenzaA__AJJ99857__NA

SEQ ID NO: 28364 - RNA, 1410 nt, Artificial Sequence
  derived and/or modified CDS sequence (AUadapt) from InfluenzaA__AJJ99868__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgugaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucucgucccggaacggcuucgagaugaucugggaccccaacggguggaccggcaccgacaacaacuucagcaucaagcagaacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 28365 - RNA, 1410 nt, Artificial Sequence; identical to SEQ ID NO: 21559
  derived and/or modified CDS sequence (AUadapt) from InfluenzaA__AJJ99879__NA

SEQ ID NO: 28366 - RNA, 1410 nt, Artificial Sequence; identical to SEQ ID NO: 16318
  derived and/or modified CDS sequence (AUadapt) from InfluenzaA__AJJ99890__NA

SEQ ID NO: 28367 - RNA, 1410 nt, Artificial Sequence
  derived and/or modified CDS sequence (AUadapt) from InfluenzaA__AJJ99901__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcucgugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacagcuucuccaucaagcaggacaucgucgggaucaacgaguggucgggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucgacuccgggaccgugggcuggagcuggcccgacggcgccgagcugccguucacgaucgacaaguga

SEQ ID NO: 28368 - RNA, 1410 nt, Artificial Sequence
  derived and/or modified CDS sequence (AUadapt) from InfluenzaA__AJJ99912__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccaagaucacgugcgugugccgggacaacuggcacggcagcaaccgccccuggguguccuucaaccagaaccucgaguaccagaucggguacaucugcucgggcaucuucggggacaacccgcggcccaaggacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggucgggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 28369 - RNA, 1410 nt, Artificial Sequence; identical to SEQ ID NO: 22659
  derived and/or modified CDS sequence (AUadapt) from InfluenzaA__AJJ99923__NA

SEQ ID NO: 28370 - RNA, 1410 nt, Artificial Sequence; identical to SEQ ID NO: 23111
  derived and/or modified CDS sequence (AUadapt) from InfluenzaA__AJJ99934__NA

SEQ ID NO: 28371 - RNA, 1410 nt, Artificial Sequence; identical to SEQ ID NO: 22659
  derived and/or modified CDS sequence (AUadapt) from InfluenzaA__AJJ99945__NA

SEQ ID NO: 28372 - RNA, 1410 nt, Artificial Sequence
  derived and/or modified CDS sequence (AUadapt) from InfluenzaA__AJJ99956__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccgugcuguccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggucgggcuacuccgggagcuucgugcagcacccggagcugacgggccucgacugcauccgccccugcuucugggucgagcugauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 28373 - RNA, 1410 nt, Artificial Sequence; identical to SEQ ID NO: 16318
  derived and/or modified CDS sequence (AUadapt) from InfluenzaA__AJJ99967__NA

SEQ ID NO: 28374 - RNA, 1413 nt, Artificial Sequence
  derived and/or modified CDS sequence (AUadapt) from InfluenzaA__AJJ99991__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacugcaccugggugaaccacaccuacgucaacaucaacaacacgaacgugguggcgggggaggacaagaccuccgucacccuggccggcaacagcucccugugcucgaucuccggcugggccaucuacaccaaggacaacagcauccggaucggguccaagggcgacguguucgugauccgcgagccguucaucucgugcucccaccucgagugccggacguucuuccugacccagggggcccugcucaacgacaagcacagcaacggcaccgucaaggaccgcucccccuaccgggcccugaugagcugcccccugggggaggcgcccuccccguacaacucgaaguucgagagcguggccugguccgccagcgccugccacgacggcaugggcuggcucaccaucgggaucuccggccccgacaacggggcgguggccguccugaaguacaacggcaucaucacgggcaccaucaagucguggaagaagcagauccugcgcacccaggaguccgagugcgugugcaugaacgggagcugcuucaccaucaugacggacggccccuccaacaaggccgccucguacaagaucuucaagaucgagaaggggaaggugaccaaguccaucgagcucaacgcccccaacuuccacuacgaggagugcagcugcuacccggacaccggcaucgucaugugcgugugccgggacaacuggcacggguccaaccgccccugggugagcuucaaccagaaccuggacuaccagaucggcuacaucugcuccggcgucuucggggacaacccccggcccgaggacggcgaggggucgugcaacccggugaccguggacggcgcgaacggggucaagggcuucuccuacaaguacgacaacggcguguggaucgggcgcaccaagagcaaccggcugcgcaagggcuucgagaugaucugggaccccaacggguggacgaacaccgacuccgacuucucggugaagcaggacgucguggccaucaccgacugguccggcuacagcgggagcuucgugcagcaccccgagcucacgggccuggacugcauccggcccugcuucugggucgagcuggugcgcggccucccgcgggagaacaccaccaucuggaccuccgggucguccaucagcuucugcggcgucaacuccgacacggccaacuggagcuggcccgacggggccgagcugcccuucaccaucgacaaguga

SEQ ID NO: 28375 - RNA, 1410 nt, Artificial Sequence; identical to SEQ ID NO: 28349
  derived and/or modified CDS sequence (AUadapt) from InfluenzaA__AJK00003__NA

SEQ ID NO: 28376 - RNA, 1410 nt, Artificial Sequence
  derived and/or modified CDS sequence (AUadapt) from InfluenzaA__AJK00014__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcgugaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcucgaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccucgcggaagggcuucgagaugaucugggaccccaacggguggaccggcaccgacaacaacuucuccacgaagcaggacaucguggggaucaacgaguggagcggcuacuccgggagcuucgugcagcacccggagcugaccggccuggacugcauccgccccugcuucugggucgagcucauccggggccgccccaaggagaacaccaucuggaccuccgggagcaucaucuccuucugcggcgugaacagcgacacggucgggugguccuggcccgacggcgccgagcugccguucaccaucgacaacuga

SEQ ID NO: 28377 - RNA, 1410 nt, Artificial Sequence
  derived and/or modified CDS sequence (AUadapt) from InfluenzaA__AJK00025__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcucgugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacagcuucuccaucaagcaggacaucgucgggaucaacgaguggucgggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgggaccgugggcuggagcuggcccgacggcgccgagcugccguucacgaucgacaaguga

SEQ ID NO: 28378 - RNA, 1410 nt, Artificial Sequence
  derived and/or modified CDS sequence (AUadapt) from InfluenzaA__AJK00036__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacaucaacuucgccgcgggccaguccgucgugagcgugaagcuggccgggaacuccucgcucugcccggucuccggcugggccaucuacagcaaggacaacuccauccgcaucggcagcaagggggacguguucgugauccgggagcccuucaucuccugcagcccccuggagugccgcacguucuuccugacccagggcgcccuccugaacgacaagcacuccaacgggaccaucaaggaccggagccccuaccgcacccugauguccugcccgaucggcgagguccccagccccuacaacucgcgguucgaguccguggccuggagcgcguccgccugccacgacgggaucaacuggcucacgaucggcaucagcggccccgacaacggggccguggccguccugaaguacaacggcaucaucaccgacaccaucaaguccuggcgcaacaacauccugcggacccaggagagcgagugcgcgugcgugaacggguccugcuucacgaucaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccucgcggaagggcuucgagaugaucugggaccccaacggguggaccggcaccgacaacaacuucuccaucaagcaggacaucgucgggaucaacgaguggagcggcuacuccgggagcuucgugcagcacccggagcugaccggccuggacugcauccgccccugcuucuggguggagcucauccggggccgccccaaggagaacacgaucuggaccuccgggagcuccaucagcuucugcggcgucaacuccgacaccgugggguggagcuggcccgacggcgccgagcugccguucaccaucgacaaguga

SEQ ID NO: 28379 - RNA, 1410 nt, Artificial Sequence; identical to SEQ ID NO: 23359
  derived and/or modified CDS sequence (AUadapt) from InfluenzaA__AJK00047__NA

SEQ ID NO: 28380 - RNA, 1410 nt, Artificial Sequence; identical to SEQ ID NO: 23359
  derived and/or modified CDS sequence (AUadapt) from InfluenzaA__AJK00058__NA

SEQ ID NO: 28381 - RNA, 1410 nt, Artificial Sequence
  derived and/or modified CDS sequence (AUadapt) from InfluenzaA__AJK00069__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacuucaacaucuccaacacgaacuucgccgcgggccagagcguggucuccgugaagcuggccgggaacagcucccucugcccggugucgggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagucggucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucucgucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 28382 - RNA, 1413 nt, Artificial Sequence; identical to SEQ ID NO: 19863
  derived and/or modified CDS sequence (AUadapt) from InfluenzaA__AJK00081__NA

SEQ ID NO: 28383 - RNA, 1413 nt, Artificial Sequence; identical to SEQ ID NO: 19034
  derived and/or modified CDS sequence (AUadapt) from InfluenzaA__AJK00093__NA

SEQ ID NO: 28384 - RNA, 1413 nt, Artificial Sequence
  derived and/or modified CDS sequence (AUadapt) from InfluenzaA__AJK00105__NA
augucgcccaaccagaagaucaucaccaucggcuccaucagcaucgccaucgggaucaucucccugaugcuccagaucggcaacaccaucucgaucugggccucccacagcauccagacggggucccagaacaacaccggcaucugcaaccagcgcaucaucaccuacgagaacucgaccugggugaaccacacguacgucaacaucaacaacaccaacgugguggcgggggaggacaagaccuccgucacccuggccggcaacagcucccugugcagcaucuccggcugggccaucuacacgaaggacaacucgauccggaucggguccaagggcgacguguucgugauccgcgagccguucaucagcugcucccaccucgagugccggaccuucuuccugacccagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucacgaucgggaucuccggccccgacaacggggcgguggccguccugaaguacaacggcaucaucaccggcaccaucaagucguggaagaagcagauccugcgcacccaggaguccgagugcgugugcaugaacgggagcugcuucacgaucaugaccgacggccccuccaacaaggccgccagcuacaagaucuucaagaucgagaaggggaaggugaccaaguccaucgagcucaacgcccccaacuuccacuacgaggagugcucgugcuacccggacaccggcaucgucaugugcgugugccgggacaacuggcacggguccaaccgccccugggugagcuucaaccagaaccuggacuaccagaucggcuacaucugcuccggcgucuucggggacaacccccggcccgaggacggcgaggggucgugcaacccggugacgguggacggcgcgaacggggucaagggcuucuccuacaaguacgacaacggcguguggaucgggcgcaccaagagcaaccggcugcgcaagggcuucgagaugaucugggaccccaacggguggaccaacaccgacuccgacuucagcgugaagcaggacgucguggccaucacggacuggucgggcuacuccgggagcuucgugcagcaccccgagcucaccggccuggacugcauccggcccugcuucugggucgagcuggugcgcggccucccgcgggagaacaccaccaucuggacguccgggucguccaucagcuucugcggcgucaacuccgacaccgccaacuggagcuggcccgacggggccgagcugcccuucaccaucgacaaguga

SEQ ID NO: 28385 - RNA, 1410 nt, Artificial Sequence; identical to SEQ ID NO: 21415
  derived and/or modified CDS sequence (AUadapt) from InfluenzaA__AJK00116__NA

SEQ ID NO: 28386 - RNA, 1410 nt, Artificial Sequence; identical to SEQ ID NO: 20247
  derived and/or modified CDS sequence (AUadapt) from InfluenzaA__AJK00127__NA

SEQ ID NO: 28387 - RNA, 1410 nt, Artificial Sequence; identical to SEQ ID NO: 16318
  derived and/or modified CDS sequence (AUadapt) from InfluenzaA__AJK00138__NA

SEQ ID NO: 28388 - RNA, 1350 nt, Artificial Sequence
  derived and/or modified CDS sequence (AUadapt) from InfluenzaA__AJK00152__NA
augaaucccaaccagaagaucaucaccaucggcucgaucugcauggugaccgggaucgucucccugaugcuccagaucggcaacaucaucagcaugugggugucccacagcauccagacgcgcaaucagcaccagaccgagccgauccggaacaccaacuuccugaccgagaacgccguggccuccgucacgcuggcggggaacagcucccucugucccauccgcggcugggccgugcacagcaaggacaacuccauccggaucgggagcaagggcgacguguucgucauccgcgagcccuuuaucuccugcagccaccuggagugccggaccuucuuccugacccagggcgcccucaucaacgauaagcacuccaacgggaccgugaaggaccgcagcccccaccggacgcugauguccugcccggugggcgaggcccccagccccuauaacucccgcuucgagucggucgccugguccgcgagcgccugccacgacgggaccaguuggcugaccaucggcaucuccgggcccgacaacggcgccguggccgugcucaaguacaacggcaucaucaccgacacgaucaagagcuggcggaacaauauccugcgcacccaggaguccgagugcgcgugcgucaacgggagcugcuucaccgugaugaccgacggcccguccaaugggcaggccagcuacaagaucuucaagauggagaagggcaagguggucaaguccguggagcugaacgcccccaacuaccacuaugaggagugcagcugcuaccccgacgccggcgagaucacgugcgugugccgggauaacuggcacggguccaaccgccccugggucagcuucaaccagaaccucgaguaucagaucggcuacaucugcuccgggguguucggcgacaacccgcggcccaacgacgggaccggcaguugcggccccgugucccccaacggggccuacggcaucaagggguucucguucaaguacggcaauggggucuggaucggccgcaccaaguccaccaacagccgguccggcuucgagaugaucugggacccgaacggguggacgggcaccgacagcgauuucuccgugaagcaggacaucguggagaucaccgacuggagcggguacagcggcuccuucguccagcaucccgagcugaccgggcuggacugcauccgccccugcuucuggguggagcucauccggggccgccccaaggagagcacgaucuggaccuccggcagcuccaucagcuuuugcggggucaacuccgacaccgugagcugguccuggccggacggcgcggagcugcccuucaccaucgacaaguga

SEQ ID NO: 28389 - RNA, 1350 nt, Artificial Sequence; identical to SEQ ID NO: 16396
  derived and/or modified CDS sequence (AUadapt) from InfluenzaA__AJK00167__NA

SEQ ID NO: 28390 - RNA, 1350 nt, Artificial Sequence
  derived and/or modified CDS sequence (AUadapt) from InfluenzaA__AJK00178__NA
augaaucccaaccagaagaucaucaccaucggcagcaucugcauggugaucgggaucgucucccugaugcuccagaucggcaacaugaucagcaucugggccucccauagcauccgcaccgggaaccagaaccagguggagccgaucaucaacacgaacuuccccaccgagaaggccgcggccuccaucacccuggccggcaauagcucccugugccccauccgggggugggccauccacagcaaggacaacuccauccgcaucggcaguaagggcgacguguucgucauccgggagcccuucaucuccugcagccaccucgagugucgcaccuucuuccugacgcagggggcccugcucaacgacaagcacuccaauggcaccgugaaggaccggagcccgcaccgcacccugauguccugccccgugggggaggcgcccagccccuacaauucccgguucgagagcgucgccugguccgccagcgccugccacgacggcaccaguuggcugacgaucgggaucuccggcccggacaacggcgcgguggccgugcucaaguacaacgggaucaucaccgacaccaucaagaccuggcgcaacaauauccugcggacgcaggagagcgagugcgccugcgucaacggcuccugcuuuaccgugaugaccgacgggcccagcgacggccaggccuccuacaagaucuucaagauggagaagggcaaggugaucaagagcgucgagcuggaugcccccaacuaccacuacgaggagugcuccugcuaucccgacgcgggggagaucacgugcgugugccgcgacaacuggcacggcaguaaccggccguggguguccuucaaccagaaccucgaguaccagaucggguauaucugcagcggcgucuucggggacaacccccgccccaccgacggcaccggcuccugugggcccgugagccacaacggcgccuacggggugaagggcuucuccuucaaguaugggaacggcgucuggaucggccggaccaagagcccgaacucccgcagcggguucgagaugaucugggaccccaauggcugguccgagaccgacagcuccuucagcgugaagcaggacaucguggccaucacggauuggagcggguacuccggcagcuucguccagcaccccgagcugaccgggcuggacuguauccggcccugcuucuggguggagcucauccgcggccggccgaaggaguccaccguguggaccagcggcuccagcaucuccuucugcggggucaauagcgacacgguguccuggagcuggcccgacggcgccgagcugcccuucaccaucgacaaguga

SEQ ID NO: 28391 - RNA, 1350 nt, Artificial Sequence
  derived and/or modified CDS sequence (AUadapt) from InfluenzaA__AJK00199__NA
augaaucccaaccagaagaucaucaccaucggcucgaucugcauggugaucgggaucgucucccugaugcuccagaucggcaacaugaucagcaucugggugucccacagcauccagaccgggaaccagaaucagguggagccgaucaucaacacgaacuuccugaccgagaaggccgucguguccaucacccuggccggcaacagcucccucugccccauccgcgggugggcgauccacagcaaggacaauuccauccggaucggcagcaagggcgacguguucgucauccgcgagcccuucaucuccugcagccaccuggagugccggaccuucuuucugacgcagggggcccuccugaacgacaagcacuccaacggcaccgugaaggaccgcagcccccaccggacccugauguccugcccggugggggaggcccccagccccuauaacucccgcuucgagagcgucgccugguccgccagcgcgugccacgacggcaccagcuggcucacgaucgggaucuccggccccgauaacggcgccgccgccgugcugaaguacaacgggaucaucaccgacaccaucaagagcuggcggaacaacauccugcgcacccaggaguccgagugcgcgugcgugaauggcagcugcuucacggucaugaccgacgggccguccgacggccaggccucguacaagaucuucaagauggagaagggcaaggugaucaaguccguggagcucgacgcccccaauuaccacuacgaggagugcagcugcuaccccgacgccggggagaucacgugcgucugucgggacaacuggcacggcuccaaccgccccugggugagcuucaaccagaaccuggaguaccagaucggguauaucugcuccggcguguucggggacaacccgcggcccaacgacggcaccggcagcugcucccccgucagucacaacggggccuacggcgugaagggguucuccuucaaguacggcaacgggguguggaucggccgcaccaagagccccaacucccggaguggcuucgagaugaucugggacccgaacgggugguccgagaccgacagcagcuucuccgucaagcaggacaucguggcgaucaccgacuggaguggcuacuccgggagcuucgugcagcaccccgagcugaccggccucgacugcauccgccccugcuucugggucgagcugauccgggggcgccccaaggaguccacgguguggaccagcggcuccaguaucuccuucugcggcgucaacagcgacaccguguccuggagcuggccggacggggccgagcugcccuucaccaucgacaaguga

SEQ ID NO: 28392 - RNA, 1350 nt, Artificial Sequence
  derived and/or modified CDS sequence (AUadapt) from InfluenzaA__AJK00208__NA
augaaucccaaccagaagaucaucaccaucggcucgaucugcauggugaccgggaucgucucccugaugcuccagaucggcaacaucaucagcaugugggugucccacagcauccagacgcgcaaucagcaccagaccgagccgauccggaacaccaacuuccugaccgagaacgccguggccuccgucacgcuggcggggaacagcucccucugucccauccgcggcugggccgugcacagcaaggacaacuccauccggaucgggagcaagggcgacguguucgucauccgcgagcccuuuaucuccugcagccaccuggagugccggaccuucuuccugacccagggcgcccuccugaacgauaagcacuccaacgggaccgugaaggaccgcagcccccaccggacgcugauguccugcccggugggcgaggcccccagccccuauaacucccgcuucgagagcgucgccugguccgcgagcgccugccacgacgggaccaguuggcucaccaucggcaucuccgggcccgacaacggcgccguggccgugcugaaguacaacggcaucaucaccgacacgaucaagagcuggcggaacaauauccugcgcacccaggaguccgagugcgcgugcgucaacgggucgugcuucaccgugaugaccgacggcccguccaaugggcaggccagcuacaagaucuucaagauggagaagggcaagguggucaaguccguggagcucaacgcccccaacuaccacuaugaggagugcagcugcuaccccgacgccggcgagaucaucugcgugugccgggauaacuggcacggguccaaccgccccugggucagcuucaaccagaaccuggaguaucagaucggcuacaucugcuccgggguguucggcgacaacccgcggcccaacgacgggacgggcaguugcggccccgugucccccaacggggccuacggcaucaagggguucagcuucaaguacggcaauggggucuggaucggccgcaccaaguccaccaacagccgguccggcuucgagaugaucugggacccgaacggguggaccggcacggacagcgauuucuccgugaagcaggacaucguggagaucaccgacuggagcggguacagcggcuccuucguccagcaucccgagcugaccgggcucgacugcauccgccccugcuucuggguggagcugauccggggccgccccaaggagagcaccaucuggacguccggcagcuccaucagcuuuugcggggucaacuccgacaccgugagcugguccuggccggacggcgcggagcugcccuucaccaucgacaaguga

SEQ ID NO: 28393 - RNA, 1350 nt, Artificial Sequence
  derived and/or modified CDS sequence (AUadapt) from InfluenzaA__AJK00219__NA
augaaucccaaccagaagaucaucaccaucggcucgaucugcauggugaccgggaucgucucccugaugcuccagaucggcaacaucaucagcaugugggugucccacagcauccagacgcgcaaucagcaccaggccgagccgauccggaacaccaacuuccugaccgagaacgccguggcguccgucacccuggccgggaaccucagccugugucccauccgcggcugggccgugcacuccaaggacaacaacauccggaucgggagcaagggcgacguguucgucauccgcgagcccuuuaucuccugcagccaccuggagugccggacguucuuccucacccagggcgcccugcugaacgauaagcacuccaacgggaccgugaaggaccgcagcccccaccggacccucauguccugcccggugggcgaggcccccagccccuauaacucccgcuucgagagcgucgcgugguccgccagcgccugccacgacgggacguccuggcugaccaucggcaucagugggcccgacaacggcgccguggcggugcugaaguacaacggcaucaucaccgacaccaucaagagcuggcggaacaauauccuccgcacgcaggaguccgagugcgccugcgucaacgggagcugcuucaccgugaugaccgacggcccguccaaugggcaggccucguacaagaucuucaagauggagaagggcaagguggucaaguccguggagcugaacgcccccaacuaccacuaugaggagugcagcugcuaccccgacgccggcgagaucaucugcgugugccgggauaacuggcacggguccaaccgccccugggucagcuucaaccagaaccuggaguaucagaucggcuacaucugcuccgggguguucggcgacaacccgcggcccaacgacgggaccggcaguugcggccccgugucccccaacggggcguacggcaucaagggguucagcuucaaguacggcaauggggucuggaucggccgcacgaaguccaccaacagccgguccggcuucgagaugaucugggacccgaacggguggaccggcaccgacagcgauuucuccgugaagcaggacaucguggagaucacggacuggagcggguacuccggcagcuucguccagcaucccgagcucaccgggcuggacugcauccgccccugcuucuggguggagcugauccggggccgccccaaggagagcaccaucuggaccuccggcagcuccaucagcuuuugcggggucaacuccgacacggugagcugguccuggccggacggcgccgagcuccccuucaccaucgacaaguga

SEQ ID NO: 28394 - RNA, 1350 nt, Artificial Sequence
  derived and/or modified CDS sequence (AUadapt) from InfluenzaA__AJK00230__NA
augaaucccaaccagaagaucaucaccaucggcucgaucugcauggugaccgggaucgucucccugaugcuccagaucggcaacaucaucagcaugugggugucccacagcauccagacgcgcaaucagcaccagaccgagccgauccggaacaccaacuuccugaccgagaacgccguggccuccgucacgcuggcggggaacagcucccucugccccauccgcggcugggccgugcauagcaaggacaacuccauccggaucgggagcaagggcgacguguucgucauccgcgagcccuucaucuccuguagccaccuggagugccggaccuucuuccugacccagggcgcccucaucaacgacaagcacuccaaugggaccgugaaggaccgcagcccccaccggacgcugauguccugcccggugggcgaggcccccagccccuacaacucccgcuuugagucggucgccugguccgcgagcgccugccacgacgggaccagcuggcugaccaucggcaucuccgggcccgacaacggcgccguggccgugcucaaguauaacggcaucaucaccgacacgaucaagagcuggcggaacaacauccugcgcacccaggaguccgagugcgcgugcgucaaugggagcugcuucaccgugaugaccgacggcccguccaacgggcaggccagcuacaagaucuucaagauggagaagggcaagguggucaaguccguggagcugaaugcccccaacuaccacuacgaggagugcagcugcuaucccgacgccggcgagaucaucugcgugugccgggacaacuggcacggguccaaccgccccugggucagcuuuaaccagaaccucgaguaccagaucggcuacaucugcuccgggguguucggcgacaauccgcggcccaacgacgggacgggcagcugcggccccgugucccccaacggggccuacggcaucaagggguucucguuuaaguacggcaacggggucuggaucggccgcaccaaguccaccaacagccgguccggcuucgagaugaucugggacccgaacggguggaccggcacggauagcgacuucuccgugaagcaggacaucguggagaucaccgacuggagcggguacagcggcuccuuuguccagcaccccgagcugaccgggcuggacugcauccgccccugcuucuggguggagcucauccggggccgccccaaggagagcaccaucuggacguccggcagcuccaucaguuucugcggggucaacuccgacaccgugagcugguccuggccggacggcgcggagcugcccuucaccaucgacaaguga

SEQ ID NO: 28395 - RNA, 1380 nt, Artificial Sequence
  derived and/or modified CDS sequence (AUadapt) from InfluenzaA__AJS18470__NA
augaaucccaaccagaagaucacgugcaucucggccaccggcgugacccuguccgucgugucgcuccugaucgggaucgccaaccugggccucaacaucgggcugcacuacaagguggacgauuccaccaccaucaacaucccgaacaugaacgagaccaaccccacgaucaccaacaucaccaacaucaucgucaacaagaacgaggagcgcaccuuccugaaccucacgaagccccugugugaggugaacucguggcacauccuguccaaggacaacgcgauccggaucggcgaggacgcccacauccucgugacccgcgagcccuaccugucgugcgauccgcaggggugccggauguucgcccugucccagggcaccacccuccgcggccggcacgccaacgggacgauccacgaccgcucgcccuuccgggcccugaucuccugggagaugggccaggcgcccucgcccuacaauacccgcgucgagugcaucgggugguccucgaccuccugccacgacggcaucucgcggauguccaucugcaucucggggccgaacaauaacgccuccgccguggugugguaccgcggccggcccgucaccgagauccccucgugggugggcaacauccugcgcacgcaggaguccgagugcgugugccacaaggggaucugccccgucgugaugaccgacggcccggccaacaauaaggcggccaccaagaucaucuacuucaaggaggggaagauccagaagaucgaggagcuccagggcaacgcccagcacguggaggagugcucgugcuacggcgccgccgggaugaucaagugcgucugccgggauaacuggaagggcgcgaaccgccccaucaucaccaucgaccccgagaugaugacgcacaccucgaaguaccugugcuccaagauccugaccgacaccucgcggcccaacgauccgacgaacgggaacugcgacgcccccaucaucggcgggucccccgaccccggcgugaagggcuucgccuaccucgacggggagaacaguuggcugggccgcaccaucuccaaggacucgcgguccggguacgagaugcugaaggugccgaacgccgagaccgacacccagucgggccccacguccuaccagcucaucgucaacaaccagaacuggaguggguacuccggcgccuucaucgacuacugggcgaacaagggcugcuucaaccccugcuucuauguggagcugauccgcgggcggcccaaggagaucgacgugcuguggaccucgaacuccauggucgcccucugcggcucgcgcgagcggcugggguccuggucguggcacgacggcgccgagaucaucuacuucaaguga

SEQ ID NO: 28396 - RNA, 1380 nt, Artificial Sequence; identical to SEQ ID NO: 16411
  derived and/or modified CDS sequence (AUadapt) from InfluenzaA__AJS18481__NA

SEQ ID NO: 28397 - RNA, 1410 nt, Artificial Sequence
  derived and/or modified CDS sequence (AUadapt) from InfluenzaA__AKA59350__NA
augaaccccaaccagaagaucaucaccaucggcucggugugcaugaccaucggggucgccaaccugauccuccagaucggcaacaucaucuccaucuggaucagccacuccauccagcuggggaaccagaaccagaucgagacgugcaaccagagcgugaucaccuacgagaacaacaccugggugaaccagaccgacgucaacaucuccaacacgaacuucgccgcgggccagagcgugguguccgucaagcuggccgggaacucgucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgugugcgucaacgggucgugcuucaccgugaugaccgacggcccguccaacggccaggcgagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccgccccugcuucugggucgagcucauccggggccgccccaaggagaacaccguguggaccagcggguccagcaucuccuucugcggcgugaacagcgacaccgucgggugguccuggcccgacggcgccgagcugccguucacgaucgacaaguga

SEQ ID NO: 28398 - RNA, 1410 nt, Artificial Sequence
  derived and/or modified CDS sequence (AUadapt) from InfluenzaA__AKA59352__NA
augaaccccaaccagaagaucaucaccaucggcucggugugcaugaccaucgggauggccaaccugaugcuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaaccuggccgucggccagagcgugguguccaccaagcucgcggggaacucgucccugugcccggucagcggcugggccaucuacuccaaggacaacagcauccgcaucggcuccaagggggacguguucgugauccgggagcccuucaucagcugcucgccccuggagugccgcaccuucuuccucacccagggcgcccugcugaacgacaagcacuccaacgggacgaucaaggaccggucccccuaccgcacccucaugagcugcccgaucggcgagguccccucccccuacaacagccgguucgagagcguggccugguccgccucggcgugccacgacgggaucaacuggcugaccaucggcaucuccggccccgacaacggggccguggccguccugaaguacaacggcaucaucaccgacacgaucaagagcuggcgcaacaacauccuccggacccaggaguccgagugcgccugcgugaacgggagcugcuucaccgugaugaccgacggcccguccgacggccaggcgagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcacggacaacaacuucagcaucaagcaggacaucguggggaucaacgagugguccggcuacucgggguccuucgugcagcacccggagcugaccggccucgacugcauccgccccugcuucugggucgagcugauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 28399 - RNA, 1410 nt, Artificial Sequence
  derived and/or modified CDS sequence (AUadapt) from InfluenzaA__AKA59354__NA
augaaccccaaccagaagaucaucaccaucggcucggugugcaugaccaucggggucgccaaccugauccuccagaucggcaacaucaucuccaucuggaucagccacuccauccagcuggggaaccagaaccagaucgagacgugcaaccagagcgugaucaccuacgagaacaacaccugggccaaccagaccuacgugaacaucuccaacacgaacuucgcggccggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggcgugguccgccagcgccugccacgacgggaucaacuggcucaccaucggcaucuccggccccgacaacggggccguggcgguccugaaguacaacggcaucaucaccgacaccaucaagagcuggcgcaacaacauccugcggacgcaggaguccgagugcgugugcgugaacgggucgugcuucaccgucaugaccgacggcccguccaacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccgagaccgacaacaacuucucgaucaagcaggacaucgugggcaucaacgagugguccggguacagcggcuccuucguccagcacccggagcugacggggcuggacugcauccgccccugcuucuggguggagcucauccggggccgccccaaggagaacaccgucuggaccagcggcuccagcaucuccuucugcggggugaacagcgacaccgugggcugguccuggcccgacggggccgagcugccguucacgaucgacaaguga

SEQ ID NO: 28400 - RNA, 1380 nt, Artificial Sequence; identical to SEQ ID NO: 16414
  derived and/or modified CDS sequence (AUadapt) from InfluenzaA__AKS48026__NA

SEQ ID NO: 28401 - RNA, 1380 nt, Artificial Sequence
  derived and/or modified CDS sequence (AUadapt) from InfluenzaA__AKS48040__NA
augaaucccaaccagaagaucacgugcaucucggccaccggcaugacccuguccguggucucgcuccugaucgggaucgccaaccugggccucaacaucgggcugcacuacaagguguccgacaguaccaccaucaacaucccgaacaugaacgagaccaaccccacgaccaccaacaucaccaacaucaucgugaacaagaacgaggagcgcacguuccugaaccucaccaagccccugugugaggucaacuccuggcacauccugucgaaggacaacgcgauccggaucggcgaggacgcccacauccucgugacccgcgagcccuaccuguccugcgacccgcaggggugucggauguucgcccugucgcagggcaccacgcuccgcggccggcacgccaacgggaccauccacgaccgcucccccuuccgggcccugaucucgugggagaugggccaggcgcccucccccuacaauacccgcguggagugcaucggguggucguccaccucgugccacgacggcaucucccggaugucgaucugcaucuccgggccgaacaacaaugccucggccgucgugugguaccgcggccggcccgugacggagauccccuccugggucggcaacauccugcgcacccaggagucggagugcgugugccacaaggggaucugccccguggucaugaccgacggcccggccaacaauaaggcggccaccaagaucaucuacuucaaggaggggaagauccagaagaucgaggagcuccagggcaacgcccagcacaucgaggagugcucgugcuacggcgccgccgggaugaucaagugcgugugucgggacaacuggaagggcgcgaaccgccccaucaucacgaucgaccccgagaugaugacccacaccuccaaguaccugugcucgaagauccugaccgacacgucccggcccaacgauccgaccaacgggaacugcgacgcccccaucaccggcgggucgcccgaccccggcgugaagggcuucgccuuccucgacggggagaacuccuggcugggccgcaccaucaguaaggacucccggucgggguacgagaugcugaaggucccgaacgccgagacggacacccaguccggccccaccucguaccagcucaucgugaacaaccagaauugguccggguacucgggcgccuucaucgacuacugggcgaacaaggagugcuucaaccccugcuuuuacguggagcugauccgcggccggcccaaggagaucgacguccugugggccuccaacucgaugguggcccucugcgggucccgcgagcggcugggcucgugguccuggcacgacggggccgagaucaucuacuucaaguga

SEQ ID NO: 28402 - RNA, 1380 nt, Artificial Sequence
  derived and/or modified CDS sequence (AUadapt) from InfluenzaA__ALO75898__NA
augaaucccaaccagaagaucacgugcaucucggccaccggcgugacccuguccgucgugucgcuccugaucgggaucgccaaccugggccucaacaucgggcugcacuacaagguguccgacaguaccaccaucaacaucccgaacaugaacgagaccaaccccacgaccaccaacaucaccaacaucaucgucaacaagaacgaggagcgcacguuccugaaccucaccaagccccugugugaggugaacuccuggcacauccugucgaaggacaacgcgauccggaucggcgaggacgcccacauccucgugacccgcgagcccuaccuguccugcgacccgcaggggugucggauguucgcccugucgcagggcaccacgcuccgcggccggcacgccaacgggaccauccacgaccgcucccccuuccgggcccugaucucgugggagaugggccaggcgcccucccccuacaauacccgcgucgagugcaucggguggucguccaccucgugccacgacggcaucucccggaugucgaucugcaucuccgggccgaacaacaaugccucggccguggugugguaccgcggccggcccgucacggagauccccuccugggugggcaacauccugcgcacccaggagucggagugcgugugccacaaggggaucugccccgucgugaugaccgacggcccggccaacaauaaggcggccaccaagaucaucuacuucaaggaggggaagauccagaagaucgaggagcuccagggcaacgcccagcacaucgaggagugcucgugcuacggcgccgccgggaugaucaagugcgugugucgggacaacuggaagggcgcgaaccgccccaucaucacgaucgaccccgagaugaugacccacaccuccaaguaccugugcucgaagauccugaccgacacgucccggcccaacgauccgaccaacgggaacugcgacgcccccaucaccggcgggucgcccgaccccggcgucaagggcuucgccuuccucgacggggagaacuccuggcugggccgcaccaucaguaaggacucccggucgggguacgagaugcugaaggugccgaacgccgagacggacacccaguccggccccaccucguaccagcucaucgugaacaaccagaauugguccggguacucgggcgccuucaucgacuacugggcgaacaaggagugcuucaaccccugcuuuuacgucgagcugauccgcggccggcccaaggagaucgacgugcugugggccuccaacucgaugguggcccucugcgggucccgcgagcggcugggcucgugguccuggcacgacggggccgagaucaucuacuucaaguga

SEQ ID NO: 28403 - RNA, 1380 nt, Artificial Sequence; identical to SEQ ID NO: 28402
  derived and/or modified CDS sequence (AUadapt) from InfluenzaA__ALO75910__NA

SEQ ID NO: 28404 - RNA, 1380 nt, Artificial Sequence
  derived and/or modified CDS sequence (AUadapt) from InfluenzaA__ALO75922__NA
augaaucccaaccagaagaucacgugcaucucggccaccggcgugacccuguccgucgugucgcuccugaucgggaucgccaaccugggccucaacaucgggcugcacuacaagguguccgacaguaccaccaucaacaucccgaacaugaacgagaccaaccccacgaccaccaacaucaccaacaucaucgucaacaagaacgaggagcgcacguuccugaaccucaccaagccccugugugaggugaacuccuggcacauccugucgaaggacaacgcgauccggaucggcgaggacgcccacauccucgugacccgcgagcccuaccuguccugcgacccgcaggggugucggauguucgcccugucgcagggcaccacgcuccgcggccggcacgccaacgggaccauccacgaccgcucccccuuccgggcccugaucucgugggagaugggccaggcgcccucccccuacaauacccgcgucgagugcaucggguggucguccaccucgugccacgacggcaucucccggaugucgaucugcaucuccgggccgaacaacaaugccucggccguggugugguaccgcggccggcccgucacggagauccccuccugggugggcaacauccugcgcacccaggagucggagugcgugugccacaaggggaucugccccgucgugaugaccgacggcccggccaacaauaaggcggccaccaagaucaucuacuucaaggaggggaagauccagaagaucgaggagcuccagggcaacgcccagcacaucgaggagugcucgugcuacggcgccgccgggaugaucaagugcgugugucgggacaacuggaagggcgcgaaccgccccaucaucacgaucgaccccgagaugaugacccacaccuccaaguaccugugcucgaagauccugaccgacacgucccggcccaacgauccgaccaacgggaacugcgacgagcccaucaccggcgggucgcccgaccccggcgucaagggcuucgccuuccucgacggggagaacuccuggcugggccgcaccaucaguaaggacucccggucgggguacgagaugcugaaggugccgaacgccgagacggacacccaguccggccccaccucguaccagcucaucgugaacaaccagaauugguccggguacucgggcgccuucaucgacuacugggccaacaaggagugcuucaaccccugcuuuuacgucgagcugauccgcggccggcccaaggagaucgacgugcugugggcguccaacucgaugguggcccucugcgggucccgcgagcggcugggcucgugguccuggcacgacggggccgagaucaucuacuucaaguga

SEQ ID NO: 28405 - RNA, 1401 nt, Artificial Sequence; identical to SEQ ID NO: 16433
  derived and/or modified CDS sequence (AUadapt) from InfluenzaA__ALT20083__NA

SEQ ID NO: 28406 - RNA, 1410 nt, Artificial Sequence
  derived and/or modified CDS sequence (AUadapt) from InfluenzaA__AMA65392__NA
augaaccccaaccagaagaucaucaccaucggcucggugugcaugaccaucgggauggccaaccugauccuccagaucggcaacaucaucuccaucugggucagccacuccauccagaucgggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccucgcugugcccgguguccggcugggccaucuacagcaaggacaacuccgugcgcaucggcagccgcggggacgucuucgugauccgggagcccuucaucuccugcagcccccucgagugccggaccuucuuccugacccagggcgcccugcucaacgacaagcacuccaacgggaccaucaaggaccgcagccccuaccggacgcugauguccugcccgaucggcgaggugcccagccccuacaacucgcgcuucgaguccgucgccuggagcgcguccgccugccacgacgggaucaacuggcugaccaucggcaucagcggccccgacuccggggccguggccgugcucaaguacaacggcaucaucaccgacaccaucaagagcuggcggaacaacauccugcgcacgcaggaguccgagugcgcgugcgucaacgggagcugcuucaccaucaugaccgacggcccguccgacggccaggccagcuacaagaucuuccggaucgagaaggggaagaucaucaaguccguggagaugaaggcccccaacuaccacuacgaggagugcucgugcuaccccgacuccagcgagaucacgugcgugugccgcgacaacuggcacggcuccaaccggcccugggucagcuucaaccagaaccuggaguaccagaugggguacaucugcuccggcguguucggggacaacccgcgccccaacgacaagaccggcagcugcggccccguguccagcaacggggccaacggcgucaagggguucagcuucaaguacggcaacgggguguggaucggccggaccaaguccaucucgucccgcaagggcuucgagaugaucugggaccccaacggguggaccggcaccgacaacaaguucagcaucaagcaggacaucguggggaucaacgagugguccggcuacagcggguccuucguccagcacccggagcucacgggccuggacugcauccggcccugcuucuggguggagcugauccgcggccggcccgaggagaacaccaucuggaccagcggguccagcaucuccuucugcggcgucaacagcgacaccguggggugguccuggcccgacggcgccgagcucccguucacgaucgacaaguga

SEQ ID NO: 28407 - RNA, 1410 nt, Artificial Sequence
  derived and/or modified CDS sequence (AUadapt) from InfluenzaA__AMA65394__NA
augaaccccaaccagaagaucaucaccaucggcucggugugcaugaccaucgggauggccaaccugauccuccagaucggcaacaucaucuccaucugggucagccacuccauccagaucgggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccucgcugugcccgguguccggcugggccaucuacagcaaggacaacuccgugcgcaucggcagcaagggggacgucuucgugauccgggagcccuucaucuccugcagcccccucgagugccgcaccuucuuccugacccagggcgcccugcucaacgacaagcacuccaacgggaccaucaaggaccggagccccuaccgcacgcugauguccugcccgaucggcgaggugcccagccccuacaacucgcgguucgaguccgucgccuggagcgcguccgccugccacgacgggaucaacuggcugaccaucggcaucagcggccccgacuccggggccguggccgugcucaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucaucaaguccguggagaugaaggcccccaacuaccacuacgaggagugcucgugcuaccccgacuccagcgagaucacgugcgugugccgggacaacuggcacggcuccaaccgccccugggucagcuucaaccagaaccuggaguaccagaugggguacaucugcuccggcguguucggggacaacccgcggcccaacgacaagaccggcagcugcggccccguguccagcaacggggccaacggcgucaagggguucagcuucaaguacggcaacgggguguggaucggccgcaccaaguccaucucgucccggaagggcuucgagaugaucugggaccccaacggguggaccggcaccgacaacaaguucagcaucaagcaggacaucguggggaucaacgagugguccggcuacagcggguccuucguccagcacccggagcucacgggccuggacugcauccgccccugcuucuggguggagcugauccggggccgccccgaggagaacaccaucuggaccagcggguccagcaucuccuucugcggcgucaacagcgacaccguggggugguccuggcccgacggcgccgagcucccguucacgaucgacaaguga

SEQ ID NO: 28408 - RNA, 1410 nt, Artificial Sequence
  derived and/or modified CDS sequence (AUadapt) from InfluenzaA__BAA00618__NA
augaaccccaaccagaagaucaucaccaugggcucgguguccaucaucaucgccaucgucugccugcucaugcagaucgccauccuggugaccacggugacccugcacuuccgccagcacgagucggacuccccgcccagcaaccaggucauccccugcgagcccaucaucaucgagcggaacaucaccgagaucguguaccucaacaacaccacgaucgagaaggagaccugcccgaaguccguggaguaccgcaacuggucgaagccccagugcaagaucaccggguucgcgcccuucuccaaggacaacucgauccggcuguccgccggcggggacaucugggucacccgcgagcccuacgugagcugcgacccgggcaagugcuaccaguucgcccuggggcagggcacgacccucgacaacaagcacuccaacgacaccauccacgaccggaucccccaccgcacccugcugaugaacgagcucggcgugcccuuccaccuggggacgcggcaggucugcaucgccuggucguccagcuccugccacgacggcaaggccuggcugcacgugugcgugaccggggacgacaagaacgcgaccgccucguucaucuacaacggccgccucgucgacuccaucgggucguggucccagaacauccugcggacccaggagagcgagugcgugugcaucaacggcacgugcaccguggucaugaccgacggcucggccuccgggcgcgccgacacccggauccuguucaucgaggagggcaagaucgugcacaucagcccccucuccgggucggcgcagcacguggaggagugcuccugcuacccgcgcuaccccgacguccggugcaucugccgcgacaacuggaagggcucgaacucccccgugguggacaucaacaugaaggacuacagcaucgacuccucguacgucugcuccggccuggugggggacacgccccggaacgacgaccgcucguccaagagcaacugccggaacccgaacaacgagcgcggcaaccacggggugaagggcugggccuucgacaacggggacgacgucuggaugggccggaccaucuccaaggaccugcgcucgggcuacgagaccuucaaggugaucgggggcugguccacccccaacagcaagucccagacgaaccggcaggucaucguggacucgaacaacuggucgggguacuccggcaucuucagcguggaggggaaguccugcaucaaccgcugcuucuacgucgagcucauccgcggccggaagcaggagacccgcgugugguggaccucgaacuccaucguggucuucugcggcaccagcgggacguacggcaccggguccuggcccgacggcgccaacaucgacuucaugcccaucuga

SEQ ID NO: 28409 - RNA, 1410 nt, Artificial Sequence
  derived and/or modified CDS sequence (AUadapt) from InfluenzaA__BAA00619__NA
augaaccccaaccagaagaucaucaccaucggcucggugucccugaccuucgccgccaucugcuuccucaugcagaucgcgauccuggucacgaccgugacccugaacuucaagcaguacgagugcgacccgcccgccaccaaccaggugaugcccugcgagcccaucaucaucgagcgcaacaucacggagaucgucuaccucaccaacaccaccaucgagcgggagaucugcccgaagcugguggaguaccgcaacuggucgaagccccagugcaagaucacgggguucgcccccuucuccaaggacaacagcauccggcuguccgccggcggggacaucugggugacccgcgagcccuacgucucgugcgacccgggccggugcuaccaguucgcccucgggcagggcaccacccuggacaacaagcacuccaacgacacgauccacgaccgcacgccccaccggacccugcucaugaacgagcugggcgugcccuuccaccuggggacccgccaggugugcaucgcguggucguccagcuccugccacgacggcaaggccuggcuccacgucugcaucaccggguacgacaagaacgccaccgccucguucaucuacgacggccggcugguggacuccaucgggagcugguccaagaacauccugcgcacccaggagucggagugcgugugcaucaacgggaccugcacggucgugaugaccgacggcuccgcgucgggccgggccgacacccgcauccucuucaucgaggagggccggaucgugcacaucagcccccuguccgggucggcccagcacgucgaggagugcuccugcuacccgcgcuaccccggcgugcggugcaucugccgcgacaacuggaagggcucgaaccggcccguggucgacaucaacgugaaggacuacuccaucaacagcuccuacgugugcucggggcuggucggcgacacgccccgcaacaacgaccgguccagcaacuccuacugccagaacccgaacaacgagaaggggaaccacggcgugaaggggugggccuucgacgacggcaacgacguguggaugggccgcaccaucucggaggacucccggucgggguaccagaccuucaaggucaucggcgggugguccacccccaacagcaagcuccagaucaaccgccaggugaucgucgacuccgacaaccgcucgggcuacuccgggaucuucucgguggagggcaaguccugcaucaaccggugcuucuacguggagcugauccgcggccggcgccaggagacccgggucugguggacgagcaacucgaucgugguguucugcgggaccuccggcaccuacgggaccggcagcuggcccgacggggccgacaucaaccugaugcccaucuga

SEQ ID NO: 28410 - RNA, 1410 nt, Artificial Sequence
  derived and/or modified CDS sequence (AUadapt) from InfluenzaA__BAA00620__NA
augaaccccaaccagaagaucaugaccaucggcucggugucccugaucaucgccgccgucugcuuccucaugcagaucgcgauccuggugaccacggugacccugcacuucaagcagugcgagugcgacucgccguccaacaaccaggucaagcccugcgagcccaucaucaucgagcgcaacaucaccgagaucguguaccucaacaacaccacgaucgagaaggagaccugccccaagcugguggaguaccggaacuggagcaagccgcagugcaagaucaccggguucgcccccuucuccaaggacaacucgauccgccuguccgccggcggggacaucugggucacccgggagcccuacgugagcugcgaccccggcaagugcuaccaguucgcccucgggcagggcacgacccuggacaacaagcacuccaacgacaccauccacgaccgcaucccgcaccggacccugcucaugaacgagcugggcgugcccuuccaccuggggacgcgccaggucugcaucgccuggucguccucguccugccacgacggcaaggcguggcuccacgugugcgugaccggggacgacaagaacgccaccgccagcuucaucuacgacggccggcuggucgacuccaucgggucguggucccagaacauccugcgcacccaggagagcgagugcgugugcaucaacggcacgugcaccguggucaugaccgacggcuccgccucggggcgggcggacacccgcauccucuucaucgaggagggcaagaucgugcacaucagcccccuguccgggucggcccagcacguggaggagugcuccugcuacccccgguacccgaacguccgcugcaucugccgggacaacuggaagggcucgaaccgccccaucguggacaucaacaugaaggacuacuccaucgacagcuccuacgugugcucgggccuggucggggacacgccccggaacgacgaccgcuccagcaaguccaacugccggaaccccaacaacgagaagggcaaccacggggugaagggcugggccuucgacaacggggacgacguguggaugggccgcaccaucucgaaggaccuccgguccggcuacgagaccuucaaggucaucgggggcugguucaccccgaacucgaagucccaggugaaccgccaggucaucguggacagcgacaaccgguccggguacucgggcaucuucuccguggagggcaagagcugcaucaaccgcugcuucuacgucgagcugauccgcgggcggggccaggagacgcgcgugugguggaccucgaacuccaucguggucuucugcgggaccagcggcaccuacgggaagggcuccuggcccgacggggccaacaucaacuucaugcccaucuga

SEQ ID NO: 28411 - RNA, 1410 nt, Artificial Sequence
  derived and/or modified CDS sequence (AUadapt) from InfluenzaA__BAA00621__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugucggccggcggggacaucugggugacccgggagcccuacgucuccugcgaccccggcaagugcuaccaguucgcccucgggcagggcaccacccuggacaacaagcacucgaacgacacgauccacgaccgcaccccgcaccggacccugcucaugaacgagcugggcgugcccuuccaccuggggacccgccaggugugcaucgccugguccagcuccucgugccacgacggcaaggcguggcuccacgucugcgugacgggguacgacaagaacgccaccgccuccuucaucuacgacggccggcugguggacucgaucggguccuggagccagaacauccugcgcacccaggaguccgagugcgucugcaucaacgggaccugcacgguggugaugaccgacggcucggccuccggccgggcggacaccaagauccucuucaucgaggagggcaagaucguccacaccucgccccugagcggguccgcccagcacguggaggagugcucgugcuacccccgcuacccgggcgugcggugcaucugccgcgacaacuggaagggcuccaaccggcccgucguggacaucaacgugaaggacuacagcaucgacuccucguacgucugcuccgggcuggugggcgacacgccccgcaagaacgaccggucguccagcuccuacugccgcaaccccaacaacgagaaggggacccacggcgugaaggggugggccuucgacgacggcaacgacgucuggaugggccggaccaucucggaggacucccgcucgggguacgagaccuucaaggugaucggcgggugguccacgccgaacagcaagcuccagaucaaccggcaggucaucguggacuccaacgaccgcucgggcuacuccgggaucuucucgguggagggcaagagcugcaucaaccggugcuucuacgucgagcugauccgcggccgcgagcaggagacccgggugugguggaccuccaacucgaucguggucuucugcgggaccuccggcacguacgggaccggcagcuggcccgacggggccgacaucaaccugaugcccaucuga

SEQ ID NO: 28412 - RNA, 1413 nt, Artificial Sequence
  derived and/or modified CDS sequence (AUadapt) from InfluenzaA__BAA06714__NA
augaaccccaaccagaagaucaucaccaucggcucgaucuccauggccaucgggaucaucagccugauccuccagaucggcaacaucaucuccaucugggugucgcacuccauccagaccgggagccagaaccacacgggcaucugcaaccagcgcaucaucaccuacgagaacuccaccugggucaaccagaccuacgugaacaucaacaacacgaacguggucgccgggaaggacaagaccucggugacccuggcgggcaacuccagccugugcccgauccggggcugggccaucuacaccaaggacaacuccauccgcaucgggucgaagggcgacguguucgucauccgggagcccuucaucuccugcagccaccucgagugccgcacguucuuccugacccagggggcccugcucaacgacaagcacuccaacggcaccgugaaggaccggucgcccuaccgccggcugauguccugcccccugggggaggccccgagccccuacaacucccgcuucgagucgaucgccuggagcgcguccgccugccacgacggcaugggcuggcucaccaucgggaucucgggccccgacgacggggccguggccguccugaaguacaacggcaucaucacggagaccaucaaguccuggaagaagcggauccugcgcacccaggagagcgagugcgugugcgugaacggcuccugcuucaccaucaugacggacgggcccucgaacggccaggcguccuaccggaucuucaagaucgagaaggggaaggucaccaagagcaucgagcucgacgccccgaacucccacuacgaggagugcucgugcuaccccgacaccggcaccgugaugugcgugugccgcgacaacuggcacggguccaaccggcccugggucagcuucaaccagaaccuggacuaccagaucggcuacaucugcuccggcguguucggggacaacccgccgcccaaggacggcaaggggucgugcgaccccgugacggucgacggcgccgacggggugaagggcuucuccuaccgcuacggcaacgggguguggaucggccggaccaagagcaaccgcuuccggaagggguucgagaugaucugggaccccaacggcuggaccgacaccgacuccgacuuccuggucaagcaggacgugguggccaugacggacuggucgggguacuccggcagcuucguccagcaccccgagcucaccggccuggacugcaugcgccccugcuucuggguggagcugguccgggggcgcccccgggagaacaccaccaucuggacgucgggcuccagcaucuccuucugcggggugaacagcgacaccgccaacugguccuggcccgacggcgcggagcucccguucaccaucgacaaguga

SEQ ID NO: 28413 - RNA, 1413 nt, Artificial Sequence
  derived and/or modified CDS sequence (AUadapt) from InfluenzaA__BAA06715__NA
augaaccccaaccagaagaucaucaccaucggcucgaucuccauggccaucgggaucaucucgcugauccuccagaucggcaacaucaucuccaucugggccagccacuccauccagaccgggucgcagaaccacacgggcaucugcaaccagcgcaucaucaccuacgagaacuccaccugggugaaccagaccuacgucaacaucaacaacacgaacgugguggcggggaaggacaagaccagcgucacccuggccggcaacuccucgcugugcccgauccggggcugggccaucuacaccaaggacaacuccauccgcaucgggucgaagggcgacguguucgugauccgggagcccuucaucuccugcagccaccucgagugccgcacguucuuccugacccagggggcccugcucaacgacaagcacuccaacggcaccgucaaggaccggucgcccuaccgcgcccugauguccugcccccugggggaggcgccgagccccuacaacucccgguucgagucgguggccuggagcgccuccgccugccacgacggcaugggcuggcucaccaucgggaucucgggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuaccgcaucuucaagaucgagaaggggaaggucaccaagucgaucgagcucgacgccccgaacuaccacuacgaggagugcuccugcuaccccgacaccggcaccgugaugugcgugugccgggacaacuggcacgggagcaaccgccccuccgucucguucaaccagaaccuggacuaccagaucggcuacaucugcuccggcguguucggggacaacccccggccgaaggacggcgaggggagcugcaaccccgugacggucgacggcgcggacggggugaagggcuucuccuaccgcuacggcaacgggguguggaucggccggaccaagucgaaccgccugcggaagggguucgagaugaucugggaccccaacggcuggaccgacaccgacuccgacuucucggucaagcaggacgugguggccaugacggacugguccggguacagcggcucguucguccagcaccccgagcucaccggccuggacugcaugcgcccgugcuucuggguggagcugauccgggggcgcccccgggagaagaccaccaucuggacguccggcagcuccaucucguucugcggggucaacuccgacaccgccaacuggagcuggcccgacggcgccgagcuccccuucaccaucgacaaguga

SEQ ID NO: 28414 - RNA, 1410 nt, Artificial Sequence
  derived and/or modified CDS sequence (AUadapt) from InfluenzaA__BAA06716__NA
augaacaccaaccagcgcaucaucaccaucggcacgaucugccugaucguggggaucaucucgcuccugcugcagaucggcaacaucauccuccuguggaugucccacagcauccagaccggggagaagucccaccccaaggucugcaaccagagcgugaucaccuacgagaacaacaccugggugaaccagacguacgucaacaucuccaacaccaacaucgccgccggccagggggugaccccgaucauccuggcgggcaacagcucccucugccccaucagcggcugggccaucuacuccaaggacaacucgauccggaucggguccaagggcgacaucuucgugaugcgcgagcccuucaucagcugcucccaccuggagugccggaccuucuuccugacgcagggggcccuccugaacgaccgccacagcaacggcaccgucaaggaccggucccccuaccgcacccugaugagcugcccgaucggggaggcccccucccccuacaacagccgguucgaguccguggccuggagcgcgucggccugccacgacggcaugggcuggcucaccaucgggaucuccggccccgacaacggggccguggccguccugaaguacaacggcaucaucacggacaccaucaagagcuggcgcaacaagauccugcggacccaggaguccgagugcgugugcaucaacggcagcugcuucaccaucaugacggacgggccguccaacggccaggcgagcuacaagcuguucaagauggagaaggggaagaucaucaaguccaucgagcucgacgcccccaacuaccacuacgaggagugcagcugcuaccccgacaccggcaagguggucugcgugugccgcgacaacuggcacgccuccaaccggcccugggugucguucgaccagaaccuggacuaccagaucggguacaucugcuccggcgucuucggcgacaacccgcgcagcaacgacgggaagggcaacugcgggcccgugcucuccaacggcgccaacggggugaagggcuucagcuuccgguacggcaacggggucuggaucggccgcaccaaguccaucagcucccggcgcggguucgagaugaucugggaccccaacggcuggaccgagacggacagcuccuucagcaugaagcaggacaucaucgcccugaccgacuggucgggguacuccggcagcuucgugcagcaccccgagcugaccggcaugaacugcauccggccgugcuucuggguggagcucauccgcgggcagcccaaggaguccaccaucuggacgagcggcuccagcaucuccuucugcggggucaacagcggcaccgcguccuggagcuggcccgacggcgccgaccugcccuucaccaucgacaaguga

SEQ ID NO: 28415 - RNA, 1413 nt, Artificial Sequence
  derived and/or modified CDS sequence (AUadapt) from InfluenzaA__BAA06717__NA
augaaccccaaccagaagaucaucaccaucggcucgaucuccauggccaucgggaucaucucgcugauccuccagaucggcaacaucaucuccaucugggccagccacuccauccagaccgggucgcagaaccacacgggcaucugcaaccagcgcaugaucaccuacgagaacuccaccugggugaaccagaccuacgucaacaucagcaacacgaacgugguggcggggaaggacaagaccuccgucacccuggccggcaacucgucccugugcccgauccggggcugggccaucuacaccaaggacaacagcauccgcaucggguccaagggcgacguguucgugauccgggagcccuucaucucgugcucccaccucgagugccgcacguucuuccugacccagggggcccugcucaacgacaagcacagcaacggcaccgucaaggaccggucccccuaccgcgcccugaugucgugcccccugggggaggcgccgucccccuacaacagccgguucgagucgguggccugguccgccagcgccugccacgacggcaugggcuggcucaccaucgggaucuccggccccgacgacggggcgguggccguccugaaguacaacggcaucaucacggagaccaucaagucguggcgcaagcagauccugcggacccaggaguccgagugcgugugcgugaacggcucgugcuucaccaucaugacggacgggcccuccgacggcccggccagcuaccgcaucuucaagaucgagaaggggaaggucaccaaguccaucgagcucgacgcccccaacuaccacuacgaggagugcucgugcuaccccgacaccggcaccgugaugugcgugugccgggacaacuggcacggguccaaccgccccugggucagcuucaaccagaaccuggacuaccagaucggcuacaucugcuccggcguguucggggacaacccgcggcccaaggacggcgaggggucgugcaaccccgugacggucgacggcgccgacggggugaagggcuucuccuaccgcuacggcaacgggguguggaucggccggaccaagagcaaccgccugcggaagggguucgagaugaucugggaccccaacggcuggaccgacaccgacuccgacuucucggucaagcaggacgugguggcgaugacggacugguccggguacagcggcucguucguccagcacccggagcucaccggccuggacugcaugcgccccugcuucuggguggagcugauccgggggcgcccccgggagaagaccaccaucuggacguccggcagcuccaucucguucugcggggucaacuccgacaccgccaacuggagcuggcccgacggcgccgagcucccguucaccaucgacaaguga

SEQ ID NO: 28416 - RNA, 1413 nt, Artificial Sequence
  derived and/or modified CDS sequence (AUadapt) from InfluenzaA__BAA06718__NA
augaaccccaaccagaagaucaucaccaucggcucgaucugcauggccaucgggaucaucucccugauccuccagaucggcaacaucgugagcaucuggaucucccacucgauccagaccgggucccagaacuacacgggcaucugcaaccagcgcaucaucaccuacgagaacagcaccugggucaaccagaccuacgugaacaucaacaacacgaacguggucgccgggcaggacaccaccuccguggcgcuggccggcaacucgucccugugcccgaucagcggcugggccaucuacuccaaggacaacucgauccggaucggguccaagggcgacguguucgucauccgcgagcccuucaucagcugcucccaccucgagugccggaccuucuuccugacgcagggggcccugcucaacgacaagcacucgaacggcaccgugaaggaccgcucccccuaccggcgccugaugagcugccccaucggggaggccccgucccccuacaacucgcgguucgagagcguggcgugguccgccagcgccugccacgacggcaugggcuggcugaccaucgggaucuccggccccgacgacggggccgucgcggugcucaaguacaacggcaucaucaccgagacgaucaagucguggcgcaagcggauccugcgcacccaggaguccgagugcgugugcgucaacggcagcugcuucaccaucaugaccgacgggcccaacaacggcccggccuccuaccggaucuucaagaucgagaaggggaagaucaccaagucgaucgagcuggacgcccccaacucccacuacgaggagugcagcugcuaccccgacgccggcacggugaugugcgugugccgcgacaacuggcacggguccaaccggcccugggucucguucaaccagaaccucgacuaccagaucggcuacaucugcuccggcguguucggggacaacccgcgccccaaggacggcaaggggagcugcgaccccgugaccgucgacggcgccgacggggugaagggcuucuccuaccgguacggcaacgggguguggaucggccgcaccaagucgaacuccagccggcgcggguucgagaugaucugggaccccaacggcuggacggacaccgacuccaaguuccuggucaagcaggacgugguggcgaugaccgacuggucgggguacagcggcuccuucguccagcacccggagcugaccggccucgacugcaugcggcccugcuucuggguggagcugguccgcgggcggccccgcgagaacacgaccaucuggaccucgggcuccagcaucuccuucugcggggugaacggcgacaccgccaacuggagcuggcccgacggcgccgagcugccguucacgaucgacaaguga

SEQ ID NO: 28417 - RNA, 1413 nt, Artificial Sequence
  derived and/or modified CDS sequence (AUadapt) from InfluenzaA__BAA06720__NA
augaaccccaaccagaagaucaucaccaucggcucgaucuccauggccaucgggaucaucagccugauccuccagaucggcaacaucaucuccaucugggugucgcacuccauccagaccgggagccagaaccacacgggcaucugcaaccagcgcaucaucaccuacgagaacuccaccugggucaaccagaccuacgugaacaucaacaacacgaacguggucgccgggaaggacaagaccucggugacccuggcgggcaacuccagccugugcccgauccucggcugggccaucuacaccaaggacaacuccauccggaucgggucgaagggcgacguguucgucauccgcgagcccuucaucuccugcagccaccuggagugccggacguucuuccugacccagggggcccuccugaacgacaagcacuccaacggcaccgugaaggaccgcucgcccuaccggcgccugauguccugcccccucggggaggccccgagccccuacaacucccgguucgagucgguggccuggagcgcguccgccugccacgacggcaugggcuggcugaccaucgggaucagcggccccgacgacggggccgucgccgugcugaaguacaacggcaucaucacggagaccaucaaguccuggaagaagcgcauccuccggacccaggagucggagugcgugugcgucaacggcuccugcuucaccaucaugacggacgggcccagcaacggcgcggccuccuaccgcaucuucaagaucgagaaggggaaggugaccaagucgaucgagcuggacgccccgaacucccacuacgaggagugcagcugcuaccccgacaccggcaccgugaugugcgucugccgggacaacuggcacggguccaaccgccccugggugucguucaaccagaaccuggacuaccagaucggcuacaucugcuccggcguguucggggacaacccgccgcccaaggacggcaaggggagcugcaaccccgucacgguggacggcgccgacggggugaagggcuucuccuaccgguacggcaacggggucuggaucggccgcaccaagucgaaccgguuccgcaagggguucgagaugaucugggaccccaacggcuggaccgacaccgacuccgacuucagcgugaagcaggacguggucgccaugacggacugguccggguacucgggcagcuucgugcagcaccccgagcucaccggccuggacugcaugcggcccugcuucugggucgagcuggugcgcgggcggccccgcgagaacaccaccaucuggacguccggcucguccaucagcuucugcggggugaacuccgacaccgcgaacuggagcuggcccgacggcgccgagcucccguucaccaucgacaaguga

SEQ ID NO: 28418 - RNA, 1410 nt, Artificial Sequence
  derived and/or modified CDS sequence (AUadapt) from InfluenzaA__BAD16637__NA
augaaccccaaccagaagaucaucaccaucggcucggugucccugaccaucgccacggucugcuuccucaugcagaucgccauccuggcgaccaccgugacccugcacuucaagcagcacgagugcgacucgccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacucgauccgccuguccgccggcggggacaucugggucacgcgggagcccuacgugagcugcgaccccggcaagugcuaccaguucgcccuggggcagggcaccacccucgacaacaagcacuccaacggcaccauccacgaccgcaucccgcaccggacgcugcugaugaacgagcucggggugcccuuccaccugggcaccaagcaggucugcguggcguggucguccucguccugccacgacgggaaggccuggcugcacgugugcgucaccggcgacgaccgcaacgccaccgccagcuucaucuacgacgggcggcucguggacuccaucggcucguggucccagaacauccugcgcacgcaggagagcgagugcgugugcaucaacgggaccugcaccgucgugaugaccgacggcuccgcgucgggccgggccgacacgcgcauccuguucaucaaggaggggaagaucgugcacaucucgccccucuccggcagcgcccagcacaucgaggagugcuccugcuacccccgguacccggacguccgcugcaucugccgggacaacuggaagggcucgaaccgccccgugaucgacaucaacauggaggacuacuccaucgacagcuccuacgugugcucggggcuggucggcgacacgccccggaacgacgacuccucguccaacagcaacugccgcgaccccaacaacgagcgggggaacccgggcgugaaggggugggccuucgacaacggcgacgacguguggaugggccgcaccaucuccaaggacucgcgguccggguacgagaccuucaaggucaucggcggguggagcacccccaacuccaagucgcaggugaaccgccaggucaucgugggcaacaacaacugguccggguacucgggcaucuucagcguggagggcaaguccugcaucaaccggugcuucuacgucgagcugauccgcgggaugccccaggagacccgcgugugguggaccucgaacuccaucguggucuucugcggcaccagcgggacguacggcaccggguccuggcccgacggcgccaacaucaacuucaugccgaucuga

SEQ ID NO: 28419 - RNA, 1410 nt, Artificial Sequence
  derived and/or modified CDS sequence (AUadapt) from InfluenzaA__BAD16638__NA
augaaccccaaccagaagaucaucaccaucggcucggugucccugaccaucgccacggucugcuuccucaugcagaucgccauccuggcgaccaccgugacccugcacuucaagcagcacgagugcgacucgccggccuccaaccaggugaugcccugcgagcccaucaucaucgagcgcaacaucacggagaucgucuaccucaacaacaccaccaucgagaaggagaucugccccgaggugguggaguaccggaacuggucgaagccgcagugccagaucaccggguucgcccccuucuccaaggacaacagcauccgccuguccgccggcggggacaucugggucacgcgggagcccuacgugucgugcgaccccggcaagugcuaccaguucgcccuggggcagggcaccacccucgacaacaagcacuccaacggcaccauccacgaccgcaucccgcaccggacgcugcugaugaacgagcucggggugcccuuccaccugggcaccaagcaggucugcguggcguggucguccagcuccugccacgacgggaaggccuggcugcacgugugcgucaccggcgacgaccgcaacgccaccgccucguucaucuacgacgggcggcucguggacuccaucggcucguggucccagaacauccugcgcacgcacgagagcgagugcgugugcaucaacgggaccugcaccgucgugaugaccgacggcuccgcgucgggccgggccgacacgcgcauccuguucaucaaggaggggaagaucgugcacaucucgccccucuccggcagcgcccagcacaucgaggagugcuccugcuacccccgguacccggacguccgcugcaucugccgggacaacuggaagggcucgaaccgccccgugaucgacaucaacauggaggacuacuccaucgacucguccuacgugugcagcgggcuggucggcgacacgccccggaacgacgacuccucguccaacucgaacugccgcgaccccaacaacgagcgggggaacccgggcgugaaggggugggccuucgacaacggcgacgacguguggaugggccgcaccaucaacaaggacucccggagcggguacgagaccuucaaggucaucggcgggugguccacccccaacucgaagucccaggugaaccgccaggucaucguggacaacaacaacuggucgggcuacuccgggaucuucagcguggagggcaagucgugcaucaaccggugcuucuacgucgagcugauccgcggccgcccccaggagacccgggugugguggaccuccaacucgaucguggucuucugcgggaccuccggcacguacgggaccggcagcuggcccgacggggccaacaucaacuucaugccgaucuga

SEQ ID NO: 28420 - RNA, 1410 nt, Artificial Sequence; identical to SEQ ID NO: 25599
  derived and/or modified CDS sequence (AUadapt) from InfluenzaA__BAD16639__NA

SEQ ID NO: 28421 - RNA, 1410 nt, Artificial Sequence
  derived and/or modified CDS sequence (AUadapt) from InfluenzaA__BAD16640__NA
augaaccccaaccagaagaucaucaccaucggcucggugucccugaccaucgccacggucugcuuccucaugcagaucgccauccuggugaccaccgugacccugcacuucaagcagcacgagugcgacucgccggcguccaaccaggucaugcccugcgagcccaucaucaucgagcgcaacaucacggagaucguguaccucaacaacaccaccaucgagaaggagaucugccccgagguggucgaguaccggaacuggagcaagccgcagugccagaucaccggguucgcccccuucuccaaggacaacucgauccgccuguccgccggcggggacaucugggugacgcgggagcccuacgugagcugcgaccccggcaagugcuaccaguucgcccuggggcagggcaccacccucgacaacaagcacuccaacgacaccauccacgaccgcaucccgcaccggacgcugcugaugaacgagcucggcguccccuuccaccuggggacccgccaggugugcguggccuggucguccucguccugccacgacggcaaggcguggcugcacgucugcgugaccggggacgacaagaacgccaccgccagcuucaucuacgacggccggcucauggacuccaucgggucguggucccagaacauccugcgcacgcaggagagcgagugcgugugcaucaacgggaccugcaccgucgugaugaccgacggcuccgccucggggcgggcggacacgcgcauccuguucaucgaggagggcaagaucgugcacaucucgccccucuccgggagcgcccagcacgucgaggagugcuccugcuacccccgguacccggacgugcgcugcaucugccgggacaacuggaagggcucgaaccgccccgugaucgacaucaacauggaggacuacuccaucgacagcuccuacgucugcucgggccuggugggggacacgccccggaacgacgaccgcuccucgaacuccaacugccggaaccccaacaacgagcgcggcaacccgggggugaagggcugggccuucgacaacggggacgacgucuggaugggccggaccaucagcaaggaccugcgcuccggcuacgagaccuucaaggugaucgggggcuggucgacccccaacuccaagagccagaucaaccggcaggucaucguggacuccaacaacuggucgggguacuccggcaucuucucgguggagggcaagagcugcaucaaccgcugcuucuacgucgagcucauccgcggccggcagcaggagacccgcgugugguggaccuccaacucgaucguggucuucugcggcaccuccgggacguacggcaccgggagcuggcccgacggcgccaacaucaacuucaugcccaucuga

SEQ ID NO: 28422 - RNA, 1410 nt, Artificial Sequence
  derived and/or modified CDS sequence (AUadapt) from InfluenzaA__BAD16641__NA
augaaccccaaccagaagaucaucaccaucggcucggccucccugaccaucgccacggugugcuuccucaugcagaucgcgauccuggucaccaccgugacccugcacuucaagcagcacgagugcgacucgccggccuccaaccaggugaugcccugcgagcccaucaucaucgagcgcaacacgaccgagaucgucuaccucaacaacaccaccaucgagaaggagaucugccccaaggugguggaguaccggaacuggucgaagccgcagugcaagaucacgggguucgcccccuucuccaaggacaacucgauccgccuguccgccggcggggacaucugggucacccgggagcccuacgugagcugcgaccccggcaagugcuaccaguucgcccuggggcagggcaccacccucgacaacaagcacuccaacgacacgauccacgaccgcaucccgcaccggacccugcugaugaacgagcucggcgugcccuuccaccuggggacccgccaggucugcaucgcguggucguccucguccugccacgacggcaaggccuggcugcacgugugcgugaccggggacgacaagaacgccacggccucguucaucuacgacggccggcucgucgacuccaucgggagcuggucccagaacauccugcgcacccaggagucggagugcgugugcaucaacgggaccugcaccguggucaugacggacggcuccgcgucggggcgggccgacacccgcauccuguucaucgaggagggcaagaucgugcacaucucgccccucuccgggagcgcccagcacguggaggagugcuccugcuacccccgguacccggacguccgcugcaucugccgggacaacuggaagggcucgaaccgccccgugguggacaucaacauggaggacuacuccaucgacucguccuacgucugcucgggccuggugggggacacgccccggaacgacgaccgcuccagcaacuccaacugccggaaccccaacaacgagaagggcaaccagggggugaagggcugggccuucgacaacggggacgacgucuggaugggccgcaccaucucgaaggaccugcgguccggcuacgagaccuucaaggugaucgggggcuggucgaccccgaacuccaagucgcagaucaaccgccaggucaucguggacuccgacaaccggagcggguacuccggcaucuucucgguggagggcaagucgugcaucaaccgcugcuucuacgucgagcucauccgcggccggaagcaggagacccgcgugugguggaccuccaacucgaucguggucuucugcggcacguccgggaccuacggcaccgggagcuggcccgacggcgccaacaucaaccugaugcccaucuga

SEQ ID NO: 28423 - RNA, 1410 nt, Artificial Sequence; identical to SEQ ID NO: 16338
  derived and/or modified CDS sequence (AUadapt) from InfluenzaA__BAD16642__NA

SEQ ID NO: 28424 - RNA, 1410 nt, Artificial Sequence
  derived and/or modified CDS sequence (AUadapt) from InfluenzaA__BAD16643__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugucggccggcggggacaucugggugacccgggagcccuacgucuccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggugugcaucgccugguccucguccucgugccacgacggcaaggcguggcuccacgucugcgugacgggguacgacaagaacgccaccgccuccuucaucuacgacggccggcugguggacagcaucggguccuggucgcagaacauccugcgcacccaggaguccgagugcgucugcaucaacgggaccugcacgguggugaugaccgacggcagcgccuccgggcgggcggacaccaagauccucuucaucgaggagggcaagaucguccacaucucgccccugagcggguccgcccagcacguggaggagugcucgugcuacccccgcuacccgggcgugcggugcaucugccgcgacaacuggaagggcuccaaccggcccgucguggacaucaacgugaaggacuacucgaucgacuccagcuacgucugcuccgggcuggugggcgacacgccccgcaacaacgaccggucguccaacagcuacugccgcaaccccaacaacgagaaggggaaccacggcgugaaggggugggccuucgacgacggcaacgacgucuggaugggccggaccaucuccgaggacucgcgcuccggguacgagaccuucaaggugaucggcggccucuucaccccgaacucgaagcugcagaucaaccggcaggucaucguggacuccgacaaccgcagcggcuacuccgggaucuucucgguggagggcaaguccugcaucaaccggugcuucuacgucgagcugauccgcggccgcgagcaggagacccgggugugguggacgagcaacucgaucguggucuucugcgggaccuccggcaccuacgggaccggcagcuggcccgacggggccgacaucaaccucaugcccaucuga

SEQ ID NO: 28425 - RNA, 1410 nt, Artificial Sequence
  derived and/or modified CDS sequence (AUadapt) from InfluenzaA__BAD16644__NA
augaaccccaaccagaagaucaucaccaucggcucggugucccugaccaucgccacgaucugcuuccucaugcagaucgccauccuggucaccaccgugacccugcacuucaagcaguacgagugcgacucgccgcccaacaaccaggugaugcccugcgagcccaucaucaucgagcgcaacaucacggagaucgucuaccucaccaacaccaccaucgagaaggagaucugcccgaagcugguggaguaccggaacugguccaagccccagugcaagaucacgggguucgcgcccuucagcaaggacaacuccauccgccugucggccggcggggacaucugggugacccgggagcccuacgucuccugcgacccgggcaagugcuaccaguucgcccucgggcagggcaccacccuggacaacaagcacucgaacgacacgauccacgaccgcacgccccaccggacccugcucaugaacgagcugggcgugcccuuccaccuggggacccgccaggugugcaucgccuggucccggagcuccugccacgacggcaaggccuggcuccacgucugcgugaccggguacgacaagaacgcgaccgccucguucaucuacgacggccgccugguggacuccaucgggucgugguccaagaacauccugcggacccaggagagcgagugcgucugcaucaacgggaccugcacgguggugaugaccgacggcuccgccucgggccgcgccgacaccaagauccucuucaucgaggagggcaagaucguccacaucucgccccuguccgggagcgcgcagcacguggaggagugcuccugcuacccgcgguaccccggcgugcgcugcaucugccgggacaacuggaagggcucgaaccgccccgucguggacaucaacgugaaggacuacuccaucgacucguccuacgucugcagcgggcuggugggcgacacgccccggaacaacgaccgcuccucgaacuccuacugccggaacccgaacaacgagaaggggaaccacggcgugaaggggugggccuucgacgacggcaacgacgucuggaugggccgcaccaucucggaggacucccggagcgggugcgagaccuucaaggugaucggcgggugguccacccccaacucgaagcuccagaucaaccgccaggucaucguggacuccgacaaccggucgggcuacuccgggaucuucagcguggagggcaaguccugcaucaaccgcugcuucuacgucgagcugauccgcggccgggagcaggagacccgcgugugguggacgucgaacucgaucguggucuucugcgggaccuccggcaccuacgggaccggcagcuggcccgacggggccgacaucaaccugaugcccaucuga

SEQ ID NO: 28426 - RNA, 1410 nt, Artificial Sequence; identical to SEQ ID NO: 16978
  derived and/or modified CDS sequence (AUadapt) from InfluenzaA__BAD16645__NA

SEQ ID NO: 28427 - RNA, 1410 nt, Artificial Sequence; identical to SEQ ID NO: 24946
  derived and/or modified CDS sequence (AUadapt) from InfluenzaA__BAD16646__NA

SEQ ID NO: 28428 - RNA, 1410 nt, Artificial Sequence; identical to SEQ ID NO: 16978
  derived and/or modified CDS sequence (AUadapt) from InfluenzaA__BAD16647__NA

SEQ ID NO: 28429 - RNA, 1410 nt, Artificial Sequence
  derived and/or modified CDS sequence (AUadapt) from InfluenzaA__BAD16648__NA
augaaccccaaccagaagaucaucaccaucggcucggugucccugaccaucgccacgaucugcuuccucaugcagaucgccauccuggucaccaccgugacccugcacuucaagcaguacgagugcagcuccccgcccaacaaccaggugaugcccugcgagcccaucaucaucgagcgcaacaucacggagaucgucuaccucaccaacaccaccaucgagaaggagaucugcccgaagcugguggaguaccggaacuggucgaagccccagugcaagaucacgggguucgcgcccuucuccaaggacaacagcauccgccuguccgccggcggggacaucugggugacccgggagcccuacgucucgugcgacccgggcaagugcuaccaguucgcccucgggcagggcaccacccuggacaacaagcacuccaacgacacgauccacgaccgcacccccuaccggacccugcucaugaacgagcugggcgugcccuuccaccuggggacccgccaggugugcaucgccuggagcuccucguccugccacgacggcaaggccuggcuccacgucugcgugacgggguacgacaagaacgcgaccgccagcuucaucuacgacggccggcugguggacuccaucgggagcugguccaagaacauccugcgcacccaggagucggagugcgucugcaucuacgggaccugcacgguggugaugaccgacggcuccgccagcgagcgggccgagaccaagauccucuucaucgaggagggcaagaucguccacaucucgccccuguccggcagcgcgcagcacguggaggagugcuccugcuacccgcgcuaccccggggugcggugcgucugccgcgacaacuggaagggcucgaaccggcccgugguggacaucaacgucaaggacuacuccaucgugagcuccuacgugugcucgggccuggucggggacacgccccgcaagaacgaccgguccagcuccagcuacugccgcaacccgaacaacgagaagggcaaccacggggugaagggcugggccuucgacgacgggaacgacgucuggaugggccggaccaucuccgaggagucgcgcuccggcuacgagaccuucaaggugaucgggggcuggagcacccccaacuccaagcuccagaucaaccgccaggugaucgucgacucggacaaccgguccggguacagcggcaucuucucgguggaggggaaguccugcaucaaccggugcuucuacguggagcugauccgcggccgcgagcaggagacccgggucugguggacgagcaacuccaucgugguguucugcggcaccagcgggaccuacggcaccggguccuggcccgacggcgccgacaucaaccugaugcccaucuga

SEQ ID NO: 28430 - RNA, 1410 nt, Artificial Sequence
  derived and/or modified CDS sequence (AUadapt) from InfluenzaA__BAE07203__NA
augaaccccaaccagaagaucaccaccaucggcucgaucugcauggugaucgggaucgucucccugaugcuccagaucggcaacaucaucagcaucugggugucccacucgauccagacggggaaccagcaccaggccgagccgugcaaccaguccaucaucaccuacgagaacaacaccugggugaaccagaccuacgucaacaucagcaacacgaacuuccugaccgagaaggccguggcguccgugacccuggccggcaacucgucccucugccccaucagcgggugggccgucuacuccaaggacaacggcauccgcaucggcagcaagggggacguguucgugauccgggagcccuucaucuccugcucgcaccuggagugccgcaccuucuuccugacgcagggcgcccuccugaacgacaagcacuccaacgggaccgucaaggaccggagcccccaccgcacccugauguccugcccggugggcgaggcccccucgcccuacaacucccgguucgagagcguggcguggucggccuccgccugccacgacgggaccagcuggcucacgaucggcaucuccggccccgacaacggggccgucgcggugcugaaguacaacggcaucaucaccgacaccaucaagagcuggcgcaacaacaucaugcggacccaggaguccgagugcgccugcgugaacgggucgugcuucacggucaugaccgacggcccguccaacggccaggccagcuacaagaucuuccgcaucgagaaggggaagguggugaaguccgccgagcugaacgcccccaacuaccacuacgaggagugcucgugcuaccccgacgcgggcgagaucacgugcgucugccgggacaacuggcacggguccaaccgccccugggugagcuucaaccagaaccucgaguaccggaucggcuacaucugcuccgggguguucggcgacaacccgcgccccaacgacggcaccgggucgugcggccccgucucccccaagggggccuacggcaucaagggguucagcuucaaguacggcaacggcguguggaucgggcggaccaaguccaccaacagccgcuccggcuucgagaugaucugggacccgaacggguggaccggcaccgacucgaacuucagcgugaagcaggacaucgucgccaucacggacugguccggguacucgggcuccuucgugcagcaccccgagcugaccggccuggacugcauccggcccugcuucugggucgagcucauccgcgggcggcccaaggagagcaccaucuggaccuccggcucguccaucagcuucugcggggugaacuccgacacggugggcuggagcuggccggacggcgccgagcugcccuucaccaucgacaaguga

SEQ ID NO: 28431 - RNA, 1410 nt, Artificial Sequence
  derived and/or modified CDS sequence (AUadapt) from InfluenzaA__BAF46322__NA
augaaccccaacccgaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccccagugcgacaucaccggguucgcgcccuucuccaaggacaacagcauccgccuguccgccggcggggacaucugggucacccgggagcccuacgugucgugcgacccggacaagugcuaccaguucgcccucggccaggggaccacgcugaacaacgugcacuccaacgacaccguccacgaccgcacccccuaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaagaagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuacccgggcguccggugcgugugccgcgacaacuggaaggggucgaaccggcccaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaacccgaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggcccgacggcgccgacaucaaccugaugcccaucuga

SEQ ID NO: 28432 - RNA, 1410 nt, Artificial Sequence; identical to SEQ ID NO: 17116
  derived and/or modified CDS sequence (AUadapt) from InfluenzaA__BAF46323__NA

SEQ ID NO: 28433 - RNA, 1410 nt, Artificial Sequence
  derived and/or modified CDS sequence (AUadapt) from InfluenzaA__BAF46324__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaucguccacgaccgcaccccguaccggacccugcucaugaacgagcugggcgugcccuuccaccugggcaccaagcaggucugcaucgccuggucguccagcuccugccacgacgggaaggccuggcuccacgugugggugacgggcgacgacaagaacgcgaccgccucguucaucuacaacgggcgccugguggacuccaucgucagcugguccaagaagauccugcggacccaggagagcgagugcgugugcaucaacgggaccugcacgguggucaugaccgacggguccgccucgggcaaggccgacaccaagauccucuucaucgaggagggcaagaucgugcacaccagcacgcuguccgggucggcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcucgggccuggugggcgacacgccccgcaagaacgacuccagcuccucgucccacugccucgaccccaacaacgaggagggcggccacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggaccuacggcacggggagcuggccggacggcgccgacaucaaccugaugcccaucuga

SEQ ID NO: 28434 - RNA, 1410 nt, Artificial Sequence
  derived and/or modified CDS sequence (AUadapt) from InfluenzaA__BAF46332__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaaguggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcggcugguggacuccaucgucagcugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcaccacguggaggagugcuccugcuacccccgguaccccggcguccgcugcgugugccgggacaacuggaaggggucgaaccgcccgaucguggacaucaacaucaaggacuacuccaucgucagcuccuacgugugcucgggccuggugggcgacacgccccggaagaacgacuccagcuccagcucccacugccucgaccccaacaacgaggagggcgggcacggggucaagggcugggccuucgacgacgggaacgacguguggaugggccgcaccaucucggagaagcugcgguccggcuacgagaccuucaaggucaucgagggguggagcaaccccaacuccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 28435 - RNA, 1410 nt, Artificial Sequence
  derived and/or modified CDS sequence (AUadapt) from InfluenzaA__BAF46334__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaaguggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcggcugguggacuccaucgucagcugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgguaccccggcguccgcugcgugugccgggacaacuggaaggggucgaaccgcccgaucguggacaucaacaucaaggacuacuccaucgucagcuccuacgugugcucgggccuggugggcgacacgccccggaagaacgacuccagcuccagcucccacugccucgaccccaacaacgaggagggcgggcacggggucaagggcugggccuucgacgacgggaacgacguguggaugggccgcaccaucucggagaagcugcgguccggcuacgagaccuucaaggucaucgagggguggagcaaccccaacuccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 28436 - RNA, 1410 nt, Artificial Sequence; identical to SEQ ID NO: 28435
  derived and/or modified CDS sequence (AUadapt) from InfluenzaA__BAF46335__NA

SEQ ID NO: 28437 - RNA, 1410 nt, Artificial Sequence
  derived and/or modified CDS sequence (AUadapt) from InfluenzaA__BAF46337__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaaguggucgaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgugcggaccccguaccgcacccugcucaugaacgagcugggcgugcccuuccaccugggcacgaagcaggucugcaucgccuggucguccagcuccugccacgacgggaaggccuggcuccacgugugcgugaccggcgacgacaagaacgcgaccgccucguucaucuacaacgggcggcuggucgacuccaucgugagcugguccaaggagauccugcgcacccaggagagcgagugcgugugcaucaacggcacgugcaccgucgugaugaccgacggguccgccucgggcaaggccgacaccaagauccucuucaucgaggagggcaagaucgugcacacgagcacccuguccgggucggcgcagcacgucgaggagugcuccugcuacccccgguaccccggcgugcgcugcgugugccgggacaacuggaaggggagcaaccgcccgaucgucgacaucaacaucaaggacuacuccaucgugagcuccuacgugugcucgggccuggucggcgacacgccccggaagaacgacuccagcuccucgucccacugccucgaccccaacaacgaggagggcgggcacggggugaagggcugggccuucgacgacgggaacgacgucuggauggcccgcaccaucagcgagaagcugcgguccggcuacgagaccuucaaggugaucgagggcuggagcaaccccaacuccaagcugcagaucaaccgccaggugaucgucgaccgggggaaccgcucgggcuacuccgggaucuucagcguggagggcaagucgugcaucaaccggugcuucuacguggagcucauccgcgggcggaaggaggagaccgagguccuguggaccuccaacagcaucgugguguucugcggcaccuccggcacguacgggaccggcagcuggccggacggggccgacaucaaccugaugcccaucuga

SEQ ID NO: 28438 - RNA, 1410 nt, Artificial Sequence; identical to SEQ ID NO: 28435
  derived and/or modified CDS sequence (AUadapt) from InfluenzaA__BAF46345__NA

SEQ ID NO: 28439 - RNA, 1410 nt, Artificial Sequence
  derived and/or modified CDS sequence (AUadapt) from InfluenzaA__BAF46346__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaaguggucgaagccgcagugcaacaucgcgggguucgcccccuucuccaaggacaacagcauccgccuguccgccggcggggacaucugggucacccgggagcccuacgugagcugcgaccccgacaagugcuaccaguucgcccucggccaggggaccacccugaacaacgugcacuccaacgacacgguccgcgaccggaccccguaccgcacccugcucaugaacgagcugggcgugcccuuccaccugggcaccaagcaggucugcaucgccuggucguccagcuccugccacgacgggaaggcguggcuccacgugugcgugacgggcgacgacaagaacgccaccgccucguucaucuacaacgggcggcugguggacuccaucgucagcugguccaaggagauccugcgcacccaggagagcgagugcgugugcaucaacgggaccugcacgguggucaugaccgacggguccgccucgggcaaggcggacaccaagauccucuucaucgaggagggcaagaucgugcacaccagcacgcuguccgggucggcccagcacguggaggagugcuccugcuacccccgguaccccggcgucaucugcgugugccgcgacaacuggaaggggagcaaccggccgaucguggacaucaacaucaaggacuacuccaucgucagcuccuacgugugcucgggccuggugggcgacacgccccgcaagaacgacuccagcuccucgucccacugccucgaccccaacaacgaggagggcggccacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggaccuacggcacggggagcuggccggacggcgccgacaucaaccugaugcccaucuga

SEQ ID NO: 28440 - RNA, 1410 nt, Artificial Sequence
  derived and/or modified CDS sequence (AUadapt) from InfluenzaA__BAF46347__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaaguggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccaccuucaucuacaacgggcggcugguggacagcaucgucuccuggucgaaggagauccugcgcacgcaggaguccgagugcgugugcaucaacgggaccugcaccguggucaugaccgacgggagcgccuccggcaaggccgacacgaagauccucuucaucgaggagggcaagaucgugcacaccucgacccugagcggguccgcgcagcacguggaggagugcagcugcuacccccgguaccccggcguccgcugcgugugccgggacaacuggaagggguccaaccgcccgaucguggacaucaacaucaaggacuacucgaucgucuccagcuacgugugcuccggccuggugggcgacacgccccggaagaacgacucguccagcuccucgcacugccucgaccccaacaacgaggagggcggccacggggucaagggcugggccuucgacgacgggaacgacguguggaugggccgcaccaucuccgagaagcugcggagcggcuacgagaccuucaaggucaucgaggggugguccaaccccaacucgaagcugcagaucaaccgccaggugaucguggaccggggcaaccgcuccggguacagcggcaucuucuccgucgagggcaagucgugcaucaaccggugcuucuacguggagcucauccgcgggcggaaggaggagaccgaggugcuguggaccagcaacuccaucgucguguucugcggcacgagcgggaccuacggcaccggguccuggccggacggcgccgacaucaaccugaugcccaucuga

SEQ ID NO: 28441 - RNA, 1410 nt, Artificial Sequence
  derived and/or modified CDS sequence (AUadapt) from InfluenzaA__BAF46349__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaaguggucgaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgcccggaccccguaccgcacccugcucaugaacgagcugggcgugcccuuccaccugggcacgaagcaggucugcaucgccuggucguccagcuccugccacgacgggaaggcguggcuccacgugugcgugaccggcgacgacaagaacgccaccgccucguucaucuacaacgggcggcugguggacuccaucgucagcugguccaaggagauccugcgcacccaggagagcgagugcgugugcaucaacggcacgugcaccguggucaugaccgacggguccgccucgggcaaggcggacaccaagauccucuucaucgaggagggcaagaucgugcacacgagcacccuguccgggucggcccagcacguggaggagugcuccugcuacccccgguaccccggcguccgcugcgugugccgggacaacuggaaggggagcaaccgcccgaucguggacaucaacaucaaggacuacuccaucgucagcuccuacgugugcucgggccuggugggcgacacgccccggaagaacgacuccagcuccucgucccacugccucgaccccaacaacgaggagggcgggcacggggucaagggcugggccuucgacgacgggaacgacguguggaugggccgcaccaucagcgagaagcugcgguccggcuacgagaccuucaaggucuucgagggguggagcaaccccaacuccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 28442 - RNA, 1410 nt, Artificial Sequence; identical to SEQ ID NO: 28435
  derived and/or modified CDS sequence (AUadapt) from InfluenzaA__BAF46350__NA

SEQ ID NO: 28443 - RNA, 1410 nt, Artificial Sequence
  derived and/or modified CDS sequence (AUadapt) from InfluenzaA__BAF46351__NA
augaaccccauccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaaguggucgaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcgugaccggcgacgacaagaacgcgaccgccucguucaucuacaacgggcggcugguggacuccaucgucagcugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaugguggacaucaacaucaaggacuacuccaucgucagcuccuacgugugcucgggccuggugggcgacacgccccggaagaacgacuccagcuccucgucccacugccucgaccccaacaacgaggagggcgggcacggggucaagggcugggccuucgacgacgggaacgacguguggaugggccgcaccaucagcgagaagcugcgguccggcuacgagaccuucaaggucaucgagggguggagcaaccccaacuccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 28444 - RNA, 1410 nt, Artificial Sequence
  derived and/or modified CDS sequence (AUadapt) from InfluenzaA__BAF46368__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgagcggaccccguaccgcacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcggcugguggacuccaucgucagcugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgguaccccggcguccgcugcgugugccgggacaacuggaaggggucgaaccgcccgaucguggacaucaacaucaaggacuacuccaucgucagcuccuacgugugcucgggccuggugggcgacacgccccggaagaacgacuccagcuccagcucccacugccucgaccccaacaacgaggagggcgggcacggggucaagggcugggccuucgacgacgggaacgacguguggaugggccgcaccaucucggagaagcugcgguccggcuacgagaccuucaaggucaucgagggguggagcaaccccaacuccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 28445 - RNA, 1410 nt, Artificial Sequence
  derived and/or modified CDS sequence (AUadapt) from InfluenzaA__BAF46369__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccucguucaucuacaacgggaagcugguggacuccaucgucagcugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgguaccccggcguccgcugcgugugccgggacaacuggaaggggagcaaccgcccgaucguggacaucaacaucaaggacuacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggagcggcuacgagaccuuccaggucaucgaggggugguccaacagcaacuccaagcugcagaucaaccgccaggugaucguggaccggggcaaccgcucgggguacagcggcaucuucuccgucgagggcaagucgugcaucaaccggugcuucuacguggagcugauccgcgggcggaaggaggagaccgaggugcucuggaccuccaacagcaucgucguguucugcggcaccuccgggacguacggcaccgggagcuggcccgacggcgccgacaucaaccugaugccgaucuga

SEQ ID NO: 28446 - RNA, 1410 nt, Artificial Sequence
  derived and/or modified CDS sequence (AUadapt) from InfluenzaA__BAF46370__NA
augaaccccaaccagaagaucaucaccaucggcucggugucccugaccaucagcacgaucugcuucuucaugcagaucgccauccucaucaccaccgucacccugcacuucaagcaguacgaguucaacucccugccgaacaaccaggugaugcucugcgagcccacgaucaucgagcgcaacaucaccgagaucguguaccugaccaacaccacgaucgagaaggagaucugccccaagcuggccgaguaccggaacuggucgaagccccagugcaacaucaccggguucgcgccguucuccaaggacaacagcauccgccucuccgccggcggggacaucugggucacccgggagcccuacgugagcugcgaccccgacaagugcuaccaguucgcccugggccaggggaccacgcugaacaacgugcacuccaacgacaccguccacgaccgcacccccuaccggacccuccugaugaacgagcugggcgugccguuccaccucggcacgaagcaggucugcaucgccuggucguccagcuccugccacgacgggaaggccuggcugcacgugugcgugaccggcgacgacaagaacgcgaccgccagcuucaucuacaacgggcgccugguggacuccaucgucucgugguccaaggagauccuccggacccaggagagcgagugcgugugcaucaacggcacgugcaccguggucaugaccgacggguccgccagcggcaaggccgacaccaagauccuguucaucgaggagggcaagaucgugcacacgucgacccuguccgggagcgcgcagcacguggaggagugcuccugcuacccccgcuaccccggcguccggugcgugugccgcgacaacuggaaggggucgaaccggcccaucguggacaucaacaucaaggacuacuccaucgucagcuccuacgugugcagcggccucgugggcgacaccccgcgcaagaacgacuccucguccagcucccacugccuggaccccaacaacgaggagggcgggcacggggucaagggcugggccuucgacgacgggaacgacguguggaugggccggaccaucagcgagaagcugcgcuccggcuacgagacguucaaggucaucgagggguggucgaaccccaacuccaagcuccagaucaaccgccaggugaucguggaccggggcaaccggagcggguacuccggcaucuucagcgucgagggcaagucgugcaucaaccgcugcuucuacguggagcugauccgggggcgcaaggaggagaccgaggugcuguggaccuccaccagcaucgucguguucugcggcuccagcgggacguacggcaccggguccuggcccgacggcgccgacaucaaccucaugccgaucuga

SEQ ID NO: 28447 - RNA, 1410 nt, Artificial Sequence
  derived and/or modified CDS sequence (AUadapt) from InfluenzaA__BAF46371__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucgugcaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaccaaccgccaggugaucguggaccggucgaaccgguccggcuacagcgggaucuucucggucgagggcaaguccugcaucaaccgcugcuucuacguggagcucauccgggggcgcaaggaggagaccgaggugcuguggaccagcaacuccaucgucguguucugcggcacgagcggcaccuacgggaccggcuccuggccggacggggccgacaucaaccugaugcccaucuga

SEQ ID NO: 28448 - RNA, 1410 nt, Artificial Sequence
  derived and/or modified CDS sequence (AUadapt) from InfluenzaA__BAF46372__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucgcgggguucgcccccuucuccaaggacaacagcauccgccuguccgccggcggggacaucugggucacccgggagcccuacgugucgugcgaccccgacaagugcuaccaguucgcccucggccaggggaccacccugaacaacgugcacuccaacgacacgguccacgaccgcaccccguaccggacccugcucaugaacgagcugggcgugcccuuccaccugggcaccaagcaggucugcaucgccuggagcuccucguccugccacgacgggaaggcguggcuccacgugugcgugacgggcgacgacaagaacgccaccgccagcuucaucuacaacgggcgccugguggacuccaucgucagcugguccaagaagauccugcggacccaggagucggagugcgugugcaucaacgggaccugcacgguggucaugaccgacggguccgccagcggcaaggcggacaccaagauccucuucaucgaggagggcaagaucgugcacaccucgacgcuguccgggagcgcccagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcggccacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggaccuacggcacggggagcuggccggacggcgccgacaucaaccugaugcccaucuga

SEQ ID NO: 28449 - RNA, 1410 nt, Artificial Sequence
  derived and/or modified CDS sequence (AUadapt) from InfluenzaA__BAF46385__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccccgacgggaaggccuggcuccacgugugcgugaccggcgacgacaagaacgcgaccgccagcuucaucuacaacgggcgccugguggacuccaucgucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuacccgggcgcccggugcgucugccgcgacaacuggaaggggagcaaccggcccaucguggacaucaacaucaaggacuacuccaucgugucguccuacgucugcagcggccuggugggcgacacgccccgcaagaacgacuccucguccagcucccacugccucgaccccaacaacgaggagggcgggcacggggugaagggcugggccuucgacgacgggaacgacgucuggaugggccggaccaucucggagaagcugcgcuccggcuacgagaccuucaaggugaucgagggguggagcaacccgaacuccaagcugcagaccaaccggcaggucaucguggaccgcggcaaccggucgggguacuccggcaucuucagcguggagggcaagucgugcaucaaccgcugcuucuacgucgagcucauccgggggcgcaaggaggagaccgaggugcuguggaccuccaacagcaucguggucuucugcggcacguccagcaccuacgggaccggcuccuggcccgacggggccgacaucaaccugaugcccaucuga

SEQ ID NO: 28450 - RNA, 1410 nt, Artificial Sequence
  derived and/or modified CDS sequence (AUadapt) from InfluenzaA__BAF46386__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaccaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcacguccagcaccuacgggaccggcuccuggccggacggggccgacaucaaccugaugcccaucuga

SEQ ID NO: 28451 - RNA, 1410 nt, Artificial Sequence; identical to SEQ ID NO: 18966
  derived and/or modified CDS sequence (AUadapt) from InfluenzaA__BAF46387__NA

SEQ ID NO: 28452 - RNA, 1410 nt, Artificial Sequence
  derived and/or modified CDS sequence (AUadapt) from InfluenzaA__BAF46388__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccggcaggacaucguggaccgcggcaaccggucgggguacuccggcaucuucagcguggagggcaagucgugcaucaaccgcugcuucuacgucgagcucauccgggggcgcaaggaggagaacgaggugcuguggaccuccaacagcaucguggucuucugcggcaccuccgggaccuacggcacggggagcuggccggacggcgccgacaucaaccugaugcccaucuga

SEQ ID NO: 28453 - RNA, 1410 nt, Artificial Sequence
  derived and/or modified CDS sequence (AUadapt) from InfluenzaA__BAF47922__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacauccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgccagcuccuacgucugcucgggccuggugggcgacacgccccgcaagaacgacuccagcuccagcucccacugccucgaccccaacaacgaggagggcgggcacggggugaagggcugggccuucgacgacgggaacgacgucuggaugggccggaccaucucggagaagcugcgcuccggcuacgagaccuucaaggugaucgagggguggagcaaccccaacuccaagcugcagaucaaccggcaggucaucguggaccgcggcaaccggucgggguacuccggcaucuucagcguggagggcaagucgugcaucaaccgcugcuucuacgucgagcucauccgggggcgcaaggaggagaccgaggugcuguggaccuccaacagcaucguggucuucugcggcaccuccgggacguacggcaccgggagcuggccggacggcgccgacaucaaccugaugcccaucuga

SEQ ID NO: 28454 - RNA, 1410 nt, Artificial Sequence; identical to SEQ ID NO: 17096
  derived and/or modified CDS sequence (AUadapt) from InfluenzaA__BAF47923__NA

SEQ ID NO: 28455 - RNA, 1410 nt, Artificial Sequence
  derived and/or modified CDS sequence (AUadapt) from InfluenzaA__BAF47924__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacucggaggagggcgggcacggggucaagggcugggccuucgacgacgggaacgacguguggaugggccggaccaucuccgagaagcugcgcagcggcuacgagaccuucaaggucaucgaggggugguccaaccccaacucgaagcugcagaccaaccgccaggugaucguggaccggggcaaccgguccggguacagcggcaucuucucggucgaggggaaguccugcaucaaccgcugcuucuacguggagcucauccggggccgcaaggaggagaccgaggugcuguggaccagcaacuccaucgucguguucugcggcacgagcgggaccuacggcaccggguccuggccggacggcgccgacaucaaccugaugcccaucuga

SEQ ID NO: 28456 - RNA, 1410 nt, Artificial Sequence; identical to SEQ ID NO: 17114
  derived and/or modified CDS sequence (AUadapt) from InfluenzaA__BAF47925__NA

SEQ ID NO: 28457 - RNA, 1410 nt, Artificial Sequence; identical to SEQ ID NO: 17114
  derived and/or modified CDS sequence (AUadapt) from InfluenzaA__BAF47926__NA

SEQ ID NO: 28458 - RNA, 1410 nt, Artificial Sequence; identical to SEQ ID NO: 23101
  derived and/or modified CDS sequence (AUadapt) from InfluenzaA__BAF47927__NA

SEQ ID NO: 28459 - RNA, 1410 nt, Artificial Sequence; identical to SEQ ID NO: 18966
  derived and/or modified CDS sequence (AUadapt) from InfluenzaA__BAF47928__NA

SEQ ID NO: 28460 - RNA, 1410 nt, Artificial Sequence
  derived and/or modified CDS sequence (AUadapt) from InfluenzaA__BAF47929__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaccgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggacgacccugaacaacgugcacuccgacgacaccguccacgaccgcaccccguaccggacgcugcucaugaacgagcugggcgugcccuuccaccugggcaccaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggagauccugcggacgcaggagagcgagugcgugugcaucaacgggaccugcaccguggucaugaccgacggguccgccucgggcaaggccgacacgaagauccucuucaucgaggagggcaagaucgugcacaccagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucucguccuacgugugcagcggccuggugggcgacacgccccgcaagaacgacuccucguccagcucccacugccucgaccccaacaacgaggagggcggccacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaacgaggugcuguggaccuccaacagcaucgucguguucugcggcaccuccgggacguacggcaccgggagcuggccggacggcgccgacaucaaccugaugcccaucuga

SEQ ID NO: 28461 - RNA, 1410 nt, Artificial Sequence
  derived and/or modified CDS sequence (AUadapt) from InfluenzaA__BAF47930__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacggccgcaccccguaccggacccugcucaugaacgagcugggcgugcccuuccaccuggggacgaagcaggucugcaucgccuggagcuccucguccugccacgacggcaaggccuggcuccacgugugcgugaccggggacgacaagaacgcgaccgccagcuucaucuacaacggccgccugguggacuccaucgucucgugguccaaggagauccugcggacccaggagagcgagugcgugugcaucaacgggacgugcaccguggucaugaccgacggcuccgccucgggcaaggccgacaccaagauccucuucaucgaggaggggaagaucgugcacacgagcacccuguccggcucggcgcagcacguggaggagugcuccugcuacccccgcuaccccgggguccggugcgugugccgcgacaacuggaagggcagcaaccggccgaucguggacaucaacaucaaggacuacuccaccgucucguccuacgugugcagcggccuggugggggacacgccccgcaagaacgacuccucguccagcggccacugccucgaccccaacaacgaggagggcgggcacggggucaagggcugggccuucgacgacggcaacgacguguggauggggcggaccaucuccgagaagcugcgcucgggcuacgagaccuucaaggucaucgaggggugguccaaccccaacagcaagcugcagaucaaccgccaggugaucguggaccggggcaaccgguccggguacucgggcaucuucuccgucgagggcaagagcugcaucaaccgcugcuucuacguggagcucauccgggggcgcaaggaggagaccgaggugcuguggaccucgaacuccaucgucguguucugcggcacgagcgggaccuacggcaccggguccuggccggacggcgccgacaucaaccugaugcccaucuga

SEQ ID NO: 28462 - RNA, 1410 nt, Artificial Sequence; identical to SEQ ID NO: 23101
  derived and/or modified CDS sequence (AUadapt) from InfluenzaA__BAF47931__NA

SEQ ID NO: 28463 - RNA, 1410 nt, Artificial Sequence
  derived and/or modified CDS sequence (AUadapt) from InfluenzaA__BAF47932__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccucggggcacugccucgaccccaacaacgaggagggcgggcacggcgucaaggggugggccuucgacgacggcaacgacguguggaugggccggaccaucuccgagaagcugcgcagcggguacgagaccuucaaggucaucgagggcugguccaaccccaacucgaagcugcagaucaaccgccaggugaucguggaccgggggaaccgguccggcuacagcgggaucuucuccgucgagggcaagucgugcaucaaccgcugcuucuacguggagcucauccggggccgcaaggaggagaccgaggugcuguggaccagcaacuccaucgucguguucugcgggaccagcggcacguacgggaccggcuccuggccggacggggccgacaucaaccugaugcccaucuga

SEQ ID NO: 28464 - RNA, 1410 nt, Artificial Sequence; identical to SEQ ID NO: 17114
  derived and/or modified CDS sequence (AUadapt) from InfluenzaA__BAF47933__NA

SEQ ID NO: 28465 - RNA, 1410 nt, Artificial Sequence; identical to SEQ ID NO: 17116
  derived and/or modified CDS sequence (AUadapt) from InfluenzaA__BAF47934__NA

SEQ ID NO: 28466 - RNA, 1410 nt, Artificial Sequence; identical to SEQ ID NO: 17116
  derived and/or modified CDS sequence (AUadapt) from InfluenzaA__BAF47935__NA

SEQ ID NO: 28467 - RNA, 1410 nt, Artificial Sequence
  derived and/or modified CDS sequence (AUadapt) from InfluenzaA__BAF47936__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcgccugguggacuccaucgugucgugguccaaggagauccugcggacccaggagagcgagugcgucugcaucaacggcacgugcaccguggugaugaccgacggguccgccucgggcaaggccgacaccaagauccucuucaucgaggagggcaagaucguccacacgagcacccuguccgggagcgcgcagcacguggaggagugcuccugcuacccccgcuaccccggcgugcggugcgucugccgcgacaacuggaaggggucgaaccggccgaucguggacaucaacaucaaggacuacuccaucgugagcuccuacgucugcucgggccuggugggcgacacgccccgcaagaacgacuccagcuccucggggcacugccucgaccccaacaacgaggagggcgggcacggcgugaaggggugggccuucgacgacggcaacgacgucuggaugggccggaccaucuccgagaagcugcgcagcggguacgagaccuucaaggugaucgagggcugguccaaccccaacucgaagcugcagaucaaccggcaggucaucguggaccgcgggaaccgguccggcuacagcgggaucuucuccguggagggcaagucgugcaucaaccgcugcuucuacgucgagcucauccggggccgcaaggaggagaccgaggugcuguggaccagcaacuccaucguggucuucugcgggaccagcggcacguacgggaccggcuccuggccggacggggccgacaucaaccugaugcccaucuga

SEQ ID NO: 28468 - RNA, 1410 nt, Artificial Sequence
  derived and/or modified CDS sequence (AUadapt) from InfluenzaA__BAF47937__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcggccccgacaagugcuaccaguucgcccucgggcagggcaccacgcugaacaacgugcacuccaacgacaccguccacgaccgcaccccguaccggacccugcucaugaacgagcugggcgugcccuuccaccuggggacgaagcaggucugcaucgccuggagcuccucguccugccacgacggcaaggccuggcuccacgugugcgugaccggggacgacaagaacgcgaccgccagcuucaucuacaacggccgccugguggacuccaucgucagcugguccaaggagauccugcggacccaggagucggagugcgugugcaucaacgggacgugcaccguggucaugaccgacggcuccgccagcggcaaggccgacaccaagauccucuucaucgaggaggggaagaucgugcacacgucgacccuguccggcagcgcgcagcacguggaggagugcuccugcuacccccgcuaccccgggguccggugcgugugccgcgacaacuggaagggcucgaaccggccgaucguggacaucaacaucaaggacuacuccaucgucagcuccuacgugugcucgggccuggugggggacacgccccgcaagaacgacuccagcuccagcucccacugccucgaccccaacaacgaggagggcgggcacggcgucaaggggugggccuucgacgacggcaacgacguguggaugggccggaccaucucggagaagcugcgcuccggguacgagaccuucaaggucaucgagggcuggagcaaccccaacuccaagcugcagaucaaccgccaggugaucguggaccgggggaaccggucgggcuacuccgggaucuucagcgucgagggcaagucgugcaucaaccgcugcuucuacguggagcucauccggggccgcaaggaggagaccgaggugcuguggaccuccaacagcaucgucguguucugcgggaccuccggcacguacgggaccggcagcuggccggacggggccgacaucaaccugaugcccaucuga

SEQ ID NO: 28469 - RNA, 1410 nt, Artificial Sequence
  derived and/or modified CDS sequence (AUadapt) from InfluenzaA__BAF47938__NA
augaaccccaaccagaagaucaucaccaucggcucggugucccugaccaucagcacgaucugcuucuucaugcagaucgccauccucaucaccaccgucacccugcacuucaagcaguacgaguucaacucccugccgaacaaccaggugaugcucugcgagcccacgaucaucgagcgcaacaucaccgagaucguguaccugaccaacaccacgaucgagaaggagaucugccccaagcuggccgaguaccggaacuggucgaagccccagugcaacaucaccggguucgcgccguucuccaaggacaacagcauccgccucuccgccggcggggacaucugggucacccgggagcccuacgugagcugcgaccccgacaagugcuaccaguucgcccugggccaggggaccacgcugaacaacgugcacuccaacgacaccguccacggccgcacccccuaccggacccuccugaugaacgagcugggcgugccguuccaccucgggacgaagcaggucugcaucgccuggucguccagcuccugccacgacggcaaggccuggcugcacgugugcgugaccggggacgacaagaacgcgaccgccucguucaucuacaacggccgccugguggacuccaucgucagcugguccaaggagauccuccggacccaggagagcgagugcgugugcaucaacgggacgugcaccguggucaugaccgacggcuccgccucgggcaaggccgacaccaagauccuguucaucgaggaggggaagaucgugcacacgagcacccuguccggcucggcgcagcacguggaggagugcuccugcuacccccgcuaccccgggguccggugcgugugccgcgacaacuggaagggcagcaaccggcccaucguggacaucaacaucaaggacuacuccaucgucagcuccuacgugugcucgggccucgugggggacaccccgcgcaagaccgacuccagcuccucgucccacugccuggaccccaacaacgaggagggcgggcacggcgucaaggggugggccuucgacgacggcaacgacguguggaugggccggacgaucagcgagaagcugcgcuccggguacgagaccuucaaggucaucgagggcuggagcaaccccaacuccaagcuccagaucaaccgccaggugaucguggaccgggggaaccggucgggcuacuccgggaucuucagcgucgagggcaagucgugcaucaaccgcugcuucuacguggagcugauccggggccgcaaggaggagaccgaggugcuguggaccuccaacagcaucgucguguucugcgggacguccggcaccuacgggaccggcagcuggcccgacggggccgacaucaaccucaugccgaucuga

SEQ ID NO: 28470 - RNA, 1410 nt, Artificial Sequence; identical to SEQ ID NO: 17116
  derived and/or modified CDS sequence (AUadapt) from InfluenzaA__BAF47939__NA

SEQ ID NO: 28471 - RNA, 1410 nt, Artificial Sequence
  derived and/or modified CDS sequence (AUadapt) from InfluenzaA__BAF47940__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaagaagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggagaagaccgaggugcuguggaccuccaacagcaucgucguguucugcggcaccuccgggacguacggcaccgggagcuggccggacggcgccgacaucaaccugaugcccaucuga

SEQ ID NO: 28472 - RNA, 1410 nt, Artificial Sequence; identical to SEQ ID NO: 17114
  derived and/or modified CDS sequence (AUadapt) from InfluenzaA__BAF47941__NA

SEQ ID NO: 28473 - RNA, 1410 nt, Artificial Sequence
  derived and/or modified CDS sequence (AUadapt) from InfluenzaA__BAF47943__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaucgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaccaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcacguccgggaccuacggcaccgggagcuggccggacggcgccgacaucaaccugaugcccaucuga

SEQ ID NO: 28474 - RNA, 1410 nt, Artificial Sequence
  derived and/or modified CDS sequence (AUadapt) from InfluenzaA__BAF47944__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcugaccgaguaccggaacuggucgaagccgcagugcaacaucaccggguucgcccccuucuccaaggacaacagcauccgccuguccgcgggcggggacaucugggucacccgggagcccuacgugucgugcgaccccgacaagugcuaccaguucgcccucggccaggggacgacccugaacaacgugcacuccaacgacccgguccacgaccgcacccccuaccggacccugcucaugaacgagcugggcgugcccuuccaccugggcacgaagcaggucugcaucgccuggagcuccucguccugccacgacgggaaggccuggcuccacgugugcgugaccggcgacgacaagaacgccaccgcgagcuucaucuacaacgggcgccugguggacuccaucgucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcccagcacguggaggagugcuccugcuacccccgcuacccgggcguccggugcgugugccgcgacaacuggaaggggagcaaccggcccaucguggacaucaacaucaaggacuacuccaucgucucguccuacgugugcagcggccuggugggcgacacgccccgcaagaacgacuccucguccagcucccacugccucgaccccaacaacgaggagggcgggcacggggucaagggcugggcguucgacgacgggaacgacguguggaugggccggaccaucucggagaagcugcgcuccggcuacgagaccuucaaggucaucgagggguggagcaacccgaacuccaagcugcagaccaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcacguccgggaccuacggcaccgggagcuggcccgacggcgccgacaucaaccugaugcccaucuga

SEQ ID NO: 28475 - RNA, 1410 nt, Artificial Sequence
  derived and/or modified CDS sequence (AUadapt) from InfluenzaA__BAF47945__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaagcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggucguccagcuccugccacgacgggaaggccuggcuccacgugugcgugaccggcgacgacaagaacgcgaccgccucguucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccucgucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggucgaaccccaacuccaagcugcagaccaaccgccaggugaucguggaccggggcaaccggagcggguacuccggcaucuucucggucgagggcaagagcugcaucaaccgcugcuucuacguggagcucauccgggggcgcaaggaggagaccgaggugcuguggaccuccaacucgaucgucguguucugcggcacguccgggaccuacggcaccgggagcuggccggacggcgccgacaucaaccugaugcccaucuga

SEQ ID NO: 28476 - RNA, 1410 nt, Artificial Sequence
  derived and/or modified CDS sequence (AUadapt) from InfluenzaA__BAF47946__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucucggagaagcugcgcuccggcuacgagaccuucaagguccuggagggguggagcaaccccaacuccaagcuccagaccaaccgccaggugaucguggaccggggcaaccggucgggguacuccggcaucuucagcgucgagggcaagucgugcaucaaccgcugcuucuacguggagcugauccgggggcgcaaggaggagaccgaggugcuguggaccuccaacagcaucgucguguucugcggcacguccgggaccuacggcaccgggagcuggccggacggcgccgacaucaaccucaugcccaucuga

SEQ ID NO: 28477 - RNA, 1410 nt, Artificial Sequence
  derived and/or modified CDS sequence (AUadapt) from InfluenzaA__BAF47948__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaagguccacgaccgcaccccguaccggacccugcucaugaacgagcugggcgugcccuuccaccugggcaccaagcaggucugcaucgccuggucguccagcuccugccacgacgggaaggccuggcuccacgugugcgugacgggcgacgacaagaacgcgaccgccucguucaucuacaacgggcgccugguggacuccaucgucagcugguccaagaagauccugcggacccaggagagcgagugcgugugcaucaacgggaccugcacgguggucaugaccgacggguccgccucgggcaaggccgacaccaagauccucuucaucgaggagggcaagaucgugcacaccagcacgcuguccgggucggcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcucgggccuggugggcgacacgccccgcaagaacgacuccagcuccucgucccacugccucgaccccaacaacgaggagggcggccacggggucaagggcugggccuucgacgacgggaacgacguguggaugggccggaccaucagcgagaagcugcgcuccggcuacgagaccuucaaggucaucgagggguggagcaacuccaacucgaagcugcagaucaaccgccaggugaucguggaccggggcaaccgguccggguacagcggcaucuucucggucgaggggaaguccugcaucaaccgcugcuucuacguggagcucauccggggccgcaaggaggagaccgaggugcuguggaccagcaacuccaucgucguguucugcggcaccagcgggaccuacggcacgggguccuggcccgacggcgccgacaucaaccugaugccgaucuga

SEQ ID NO: 28478 - RNA, 1410 nt, Artificial Sequence
  derived and/or modified CDS sequence (AUadapt) from InfluenzaA__BAF47949__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaagguccacgaccgcaccccguaccggacccugcucaugaacgagcugggcgugcccuuccaccugggcaccaagcaggucugcaucgccuggagcuccucguccugccacgacgggaaggccuggcuccacgugugcgugacgggcgacgacaagaacgcgaccgccagcuucaucuacaacgggcgccugguggacuccaucgucagcugguccaagaagauccugcggacccaggagucggagugcgugugcaucaacgggaccugcacgguggucaugaccgacggguccgccagcggcaaggccgacaccaagauccucuucaucgaggagggcaagaucgugcacaccucgacgcuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcggccacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggaccuacggcacggggagcuggccggacggcgccgacaucaaccugaugcccaucuga

SEQ ID NO: 28479 - RNA, 1410 nt, Artificial Sequence; identical to SEQ ID NO: 17116
  derived and/or modified CDS sequence (AUadapt) from InfluenzaA__BAF47950__NA

SEQ ID NO: 28480 - RNA, 1410 nt, Artificial Sequence
  derived and/or modified CDS sequence (AUadapt) from InfluenzaA__BAF47951__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggucguccagcuccugccacgacgggaaggccuggcuccacgugugcgugaccggcgacgacaagaacgcgaccgccucguucaucuacaacgggcgccugguggacuccaucgucagcugguccaagaagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcucgggccuggugggcgacacgccccgcaagaacgacuccagcuccucgucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaacuccaacucgaagcugcagaucaaccgccaggugaucguggaccggggcaaccgguccggguacagcggcaucuucucggucgaggggaaguccugcaucaaccgcugcuucuacguggagcucauccggggccgcaaggaggagaccgaggugcuguggaccagcaacuccaucgucguguucugcggcaccagcgggacguacggcaccggguccuggcccgacggcgccgacaucaaccugaugccgaucuga

SEQ ID NO: 28481 - RNA, 1410 nt, Artificial Sequence
  derived and/or modified CDS sequence (AUadapt) from InfluenzaA__BAF47952__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaccaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcacguccgggaccuacggcaccgggagcuggccggacggcgccaacaucaaccugaugcccaucuga

SEQ ID NO: 28482 - RNA, 1410 nt, Artificial Sequence
  derived and/or modified CDS sequence (AUadapt) from InfluenzaA__BAF47953__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacgagaacgcgaccgccagcuucaucuacaacgggcgccugguggacuccaucgucagcugguccaagaagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 28483 - RNA, 1410 nt, Artificial Sequence; identical to SEQ ID NO: 28435
  derived and/or modified CDS sequence (AUadapt) from InfluenzaA__BAF47954__NA

SEQ ID NO: 28484 - RNA, 1410 nt, Artificial Sequence; identical to SEQ ID NO: 28435
  derived and/or modified CDS sequence (AUadapt) from InfluenzaA__BAF47955__NA

SEQ ID NO: 28485 - RNA, 1410 nt, Artificial Sequence
  derived and/or modified CDS sequence (AUadapt) from InfluenzaA__BAF47956__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaaguggucgaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcgugaccggcgacgacaagaacgcgaccgccucguucaucuacaacgggcggcugguggacuccaucgucagcugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggacuacuccaucgucagcuccuacgugugcucgggccuggugggcgacacgccccggaagaacgacuccagcuccucgucccacugccucgaccccaacaacgaggagggcgggcacggggucaagggcugggccuucgacgacgggaacgacguguggaugggccgcaccaucagcgagaagcugcgguccggcuacgagaccuucaaggucaucgagggguggagcaaccccaacuccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaacuucaugcccaucuga

SEQ ID NO: 28486 - RNA, 1410 nt, Artificial Sequence
  derived and/or modified CDS sequence (AUadapt) from InfluenzaA__BAF47958__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaaguggucgaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugaugaugaacgagcucggcgugcccuuccaccugggcacgaagcaggucugcaucgccuggucguccagcuccugccacgacgggaaggccuggcugcacgugugcgugaccggcgacgacaagaacgcgaccgccucguucaucuacaacgggcggcucguggacuccaucgucagcugguccaaggagauccugcgcacccaggagagcgagugcgugugcaucaacggcacgugcaccguggucaugaccgacggguccgccucgggcaaggccgacaccaagauccuguucaucgaggagggcaagaucgugcacacgagcacccucuccgggucggcgcagcacguggaggagugcuccugcuacccccgguaccccggcguccgcugcgugugccgggacaacuggaaggggagcaaccgcccgaucguggacaucaacaucaaggacuacuccaucgucagcuccuacgugugcucgggccuggugggcgacacgccccggaagaacgacuccagcuccucgucccacugccuggaccccaacaacgaggagggcgggcacggggucaagggcugggccuucgacgacgggaacgacguguggaugggccgcaccaucagcgagaagcuccgguccggcuacgagaccuucaaggucaucgagggguggagcaaccccaacuccaagcugcagaucaaccgccaggugaucguggaccggggcaaccgcucgggguacuccggcaucuucagcgucgagggcaagucgugcaucaaccggugcuucuacguggagcugauccgcgggcggaaggaggagaccgaggugcucuggaccuccaacagcaucgucguguucugcggcaccuccgggacguacggcaccgggagcuggaccgacggcgccgacaucaacuucaugccgaucuga

SEQ ID NO: 28487 - RNA, 1410 nt, Artificial Sequence
  derived and/or modified CDS sequence (AUadapt) from InfluenzaA__BAF47959__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacuacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccucguucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucucguccuacgugugcagcggccuggugggcgacacgccccgcaagaacgacuccucguccagcgggcacugccucgaccccaacaacgaggagggcgggcacggcgucaaggggugggccuucgacgacggcaacgacguguggaugggccggaccaucuccgagaagcugcgcagcggguacgagaccuucaaggucaucgagggcugguccaaccccaacucgaagcugcagaucaaccgccaggugaucguggaccgggggaaccgguccggcuacagcgggaucuucuccgucgagggcaagucgugcaucaaccgcugcuucuacguggagcucauccggggccgcaaggaggagaccgaggugcuguggaccagcaacuccaucgucguguucugcgggaccagcggcacguacgggaccggcuccuggccggacggggccgacaucaaccugaugcccaucuga

SEQ ID NO: 28488 - RNA, 1410 nt, Artificial Sequence
  derived and/or modified CDS sequence (AUadapt) from InfluenzaA__BAF47960__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacaaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccucggggcacugccucgaccccaacaacgaggagggcgggcacggcgucaaggggugggccuucgacgacggcaacgacguguggaugggccggaccaucuccgagaagcugcgcagcggguacgagaccuucaaggucaucgagggcugguccaaccccaacucgaagcugcagaucaaccgccaggugaucguggaccgggggaaccgguccggcuacagcgggaucuucuccgucgagggcaagucgugcaucaaccgcugcuucuacguggagcucauccggggccgcaaggaggagaccgaggugcuguggaccagcaacuccaucgucguguucugcgggaccagcggcacguacgggaccggcuccuggccggacggggccgacaucaaccugaugcccaucuga

SEQ ID NO: 28489 - RNA, 1410 nt, Artificial Sequence
  derived and/or modified CDS sequence (AUadapt) from InfluenzaA__BAF47975__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaaguggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcggcugguggacuccaucgucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggacuacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagcugcgguccggcuacgagaccuucaaggucaucgagggguggagcaaccccaacuccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccacaugcccaucuga

SEQ ID NO: 28490 - RNA, 1410 nt, Artificial Sequence; identical to SEQ ID NO: 17114
  derived and/or modified CDS sequence (AUadapt) from InfluenzaA__BAF47976__NA

SEQ ID NO: 28491 - RNA, 1410 nt, Artificial Sequence
  derived and/or modified CDS sequence (AUadapt) from InfluenzaA__BAF47977__NA
augaaccccaaccagaagaucaucaccaucggcucggugucccugaccaucagcacgaucugcuucuucaugcagaucgccauccucaucaccaccgucacccugcaguucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacggccgcaccccguaccggacccugcucaugaacgagcugggcgugcccuuccaccuggggacgaagcaggucugcaucgccuggagcuccucguccugccacgacggcaaggccuggcuccacgugugcgugaccggggacgacaagaacgcgaccgccagcuucaucuacaacggccgccugguggacuccaucgucucgugguccaaggagauccugcggacccaggagagcgagugcgugugcaucaacgggacgugcaccguggucaugaccgacggcuccgccucgggcaaggccgacaccaagauccucuucaucgaggaggggaagaucgugcacacgagcacccuguccggcucggcgcagcacguggaggagugcuccugcuacccccgcuaccccgggguccggugcgugugccgcgacaacuggaagggcagcaaccggccgaucguggacaucaacaucaaggacuacuccaucgucucguccuacgugugcagcggccuggugggggacacgccccgcaagaacgacuccucguccagcucccacugccucgaccccaacaacgaggagggcgggcacggcgucaaggggugggccuucgacgacggcaacgacguguggaugggccggaccaucucggagaagcugcgcuccggguacgagaccuucaaggucaucgagggcuggagcaaccccaacuccaagcugcagaccaaccgccaggugaucguggaccgggggaaccggucgggcuacuccgggaucuucagcgucgagggcaagucgugcaucaaccgcugcuucuacguggagcucauccggggccgcaaggaggagaccgaggugcuguggaccuccaacagcaucgucguguucugcgggacguccggcaccuacgggaccggcagcuggccggacggggccgacaucaaccugaugcccaucuga

SEQ ID NO: 28492 - RNA, 1410 nt, Artificial Sequence
  derived and/or modified CDS sequence (AUadapt) from InfluenzaA__BAF47978__NA
augaaccccaaccagaagaucaucaccaucggcucggugucccugaccaucagcacgaucugcuucuucaugcagaucgccauccucgucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggugacccgggagcccuacgugucgugcgaccccgacaagugcuaccaguucgcccucggccaggggaccacgcugaacaacguccacuccaacgacaccgugcacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccuggucgacuccaucgugucgugguccaaggagauccugcggacccaggagagcgagugcgugugcaucaacggcacgugcaccgucgugaugaccgacggguccgccucgggcaaggccgacaccaagauccucuucaucgaggagggcaagaucgugcacacgagcacccuguccgggucggcgcagcacgucgaggagugcuccugcuacccccgcuaccccggcgugcggugcgugugccgcgacaacuggaaggggagcaaccggccgaucgucgacaucaacaucaaggacuacuccaucgugucguccuacgugugcagcggccuggucggcgacacgccccgcaagaacgacuccucguccagcucccacugccucgaccccaacaacgaggagggcgggcacggggugaagggcugggccuucgacgacgggaacgacgccuggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 28493 - RNA, 1410 nt, Artificial Sequence
  derived and/or modified CDS sequence (AUadapt) from InfluenzaA__BAF47979__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacaaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaccaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcacguccgggaccuacggcaccgggagcuggccggacggcgccgacaucaaccugaugcccaucuga

SEQ ID NO: 28494 - RNA, 1410 nt, Artificial Sequence; identical to SEQ ID NO: 18966
  derived and/or modified CDS sequence (AUadapt) from InfluenzaA__BAF47980__NA

SEQ ID NO: 28495 - RNA, 1410 nt, Artificial Sequence
  derived and/or modified CDS sequence (AUadapt) from InfluenzaA__BAF47981__NA
augaaccccaaccagaagaucaucaccaucggcucggugucccugaccaucagcacgaucugccucuucaugcagaucgccauccugaucaccaccgucacccugcacuucaagcaguacgaguucaacuccccgcccaacaaccaggugaugcucugcgagcccacgaucaucgagcgcaacaucaccgagaucguguaccugaccaacaccacgaucgagaaggagaucugccccaagcuggccgaguaccggaaguggucgaagccgcagugcaacaucaccggguucgcgcccuucuccaaggacaacagcauccgccucuccgccggcggggacaucugggucacccgggagcccuacgugucgugcgaccccgacaagugcuaccaguucgcccugggccaggggaccacgcugaacaacgugcacuccaacgacaccguccgcaaccggaccccguaccgcacccuccugaugaacgagcugggcgugcccuuccaccucggcacgaagcaggucugcaucgccuggagcuccucguccugccacgacgggaaggccuggcugcacgugugcgugaccggcgacgacaagaacgcgaccgccagcuucaucuacaacgggcggcugguggacuccaucgucucgugguccaaggagauccuccgcacccaggagagcgagugcgugugcaucaacggcacgugcaccguggucaugaccgacggguccgccucgggcaaggccgacaccaagauccuguucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggacuacuccaucgucucguccuacgugugcagcggccucgugggcgacacgccccggaagaacgacuccucguccagcucccacugccuggaccccaacaacgaggagggcgggcacggggucaagggcugggccuucgacgacgggaacgacguguggaugggccgcaccaucucggagaagcugcgguccggcuacgagaccuucaaggucaucgagggguggagcaaccccaacuccaagcuccagaucaaccgccaggugaucguggaccggggcaaccgcucgggguacuccggcaucuucagcgucgagggcaagucgugcaucaaccggugcuucuacguggagcugauccgcgggcggaaggaggagaccgaggugcuguggaccuccaacagcaucgucguguucugcggcaccuccgggacguacggcaccgggagcuggccggacggcgccgacaucaaccucaugcccaucuga

SEQ ID NO: 28496 - RNA, 1410 nt, Artificial Sequence
  derived and/or modified CDS sequence (AUadapt) from InfluenzaA__BAF47982__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaaguggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcaaccggaccccguaccgcacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcggcugguggacuccaucgucagcugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgguaccccggcguccgcugcgugugccgggacaacuggaaggggucgaaccgcccgaucguggacaucaacaucaaggacuacuccaucgucagcuccuacgugugcucgggccuggugggcgacacgccccggaagaacgacuccagcuccagcucccacugccucgaccccaacaacgaggagggcgggcacggggucaagggcugggccuucgacgacgggaacgacguguggaugggccgcaccaucucggagaagcugcgguccggcuacgagaccuucaaggucaucgagggguggagcaaccccaacuccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 28497 - RNA, 1410 nt, Artificial Sequence; identical to SEQ ID NO: 18966
  derived and/or modified CDS sequence (AUadapt) from InfluenzaA__BAF47983__NA

SEQ ID NO: 28498 - RNA, 1410 nt, Artificial Sequence
  derived and/or modified CDS sequence (AUadapt) from InfluenzaA__BAF47984__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacggccgcaccccguaccggacccugcucaugaacgagcugggcgugcccuuccaccuggggacgaagcaggucugcaucgccuggagcuccucguccugccacgacggcaaggccuggcuccacgugugcgugaccggggacgacaagaacgcgaccgccagcuucaucuacaacggccgccugguggacuccaucgucagcugguccaaggagauccugcggacccaggagucggagugcgugugcaucaacgggacgugcaccguggucaugaccgacggcuccgccagcggcaaggccgacaccaagauccucuucaucgaggaggggaagaucgugcacacgucgacccuguccggcagcgcgcagcacguggaggagugcuccugcuacccccgcuaccccgggguccggugcgugugccgcgacaacuggaagggcucgaaccggccgaucguggacaucaacaucaaggacuacuccaucgucagcuccuacgugugcucgggccuggugggggacacgccccgcaagaacgacuccagcuccagcucccacugccucgaccccaacaacgaggagggcgaccacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 28499 - RNA, 1410 nt, Artificial Sequence
  derived and/or modified CDS sequence (AUadapt) from InfluenzaA__BAF47985__NA
augaaccccaaccagaagaucaucaccaucggcucggugucccugaccaucagcacgaucugcuucuucaugcagaucgccauccucaucaccaccgucacccugcacuucaagcaguacgaguucaacuucccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucucgaaggacaacuccauccgccugagcgccggcggggacaucugggucacccgggagcccuacguguccugcgaccccgacaagugcuaccaguucgcccucggccaggggaccacgcugaacaacgugcacagcaacgacaccguccacgaccgcaccccguaccggacccugcucaugaacgagcugggcgugcccuuccaccugggcacgaagcaggucugcaucgccugguccucguccagcugccacgacgggaaggccuggcuccacgugugcgugaccggcgacgacaagaacgcgaccgccuccuucaucuacaacgggcgccugguggacagcaucgucuccuggucgaagaagauccugcggacccaggaguccgagugcgugugcaucaacggcacgugcaccguggucaugaccgacgggagcgccuccggcaaggccgacaccaagauccucuucaucgaggagggcaagaucgugcacacgucgacccugagcggguccgcgcagcacguggaggagugcagcugcuacccccgcuaccccggcguccggugcgugugccgcgacaacuggaagggguccaaccggccgaucguggacaucaacaucaaggacuacucgaucgucuccagcuacgugugcuccggccuggugggcgacacgccccgcaagaacgacagcuccucguccagccacugccucgaccccaacaacgaggagggcgggcacggggucaagggcugggccuucgacgacgggaacgacguguggaugggccggaccaucuccgagaagcugcgcucgggcuacgagaccuucaaggucaucgaggggugguccaaccccaacagcaagcugcagaucaaccgccaggugaucguggaccggggcaaccgguccggguacagcggcaucuucuccgucgagggcaagucgugcaucaaccgcugcuucuacguggagcucauccgggggcgcaaggaggagaccgaggugcuguggaccagcaacuccaucgucguguucugcggcaccagcgggacguacggcaccggguccuggccggacggcgccgacaucaaccugaugcccaucuga

SEQ ID NO: 28500 - RNA, 1410 nt, Artificial Sequence
  derived and/or modified CDS sequence (AUadapt) from InfluenzaA__BAF47986__NA
augaaccccaaccagaagaucaucaccaucggcucggugucccugaccaucagcacgaucugcuucuucaugcagaucgccauccucaucaccaccgucacccugcacuucaagcaguacgaguucaacuucccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucucgaaggacaacuccauccgccugagcgccggcggggacaucugggucacccgggagcccuacguguccugcgaccccgacaagugcuaccaguucgcccucggccaggggaccacgcugaacaacgugcacucgaacgacaccguccacgaccgcaccccguaccggacccugcucaugaacgagcugggcgugcccuuccaccugggcacgaagcaggucugcaucgccugguccagcuccagcugccacgacgggaaggccuggcuccacgugugcgugaccggcgacgacaagaacgcgaccgccuccuucaucuacaacgggcgccugguggacucgaucgucuccuggagcaagaagauccugcggacccaggaguccgagugcgugugcaucaacggcacgugcaccguggucaugaccgacgggucggccuccggcaaggccgacaccaagauccucuucaucgaggagggcaagaucgugcacacgagcacccugagcggguccgcgcagcacguggaggagugcucgugcuacccccgcuaccccggcguccggugcgugugccgcgacaacuggaagggguccaaccggccgaucguggacaucaacaucaaggacuacagcaucgucuccucguacgugugcuccggccuggugggcgacacgccccgcaagaacgacagcuccucguccagccacugccucgaccccaacaacgaggagggcgggcacggggucaagggcugggccuucgacgacgggaacgacguguggaugggccggaccaucuccgagaagcugcgcagcggcuacgagaccuucaaggucaucgaggggugguccaaccccaacucgaagcugcagaucaaccgccaggugaucguggaccggggcaaccgguccggguacagcggcaucuucuccgucgagggcaagucgugcaucaaccgccgguucuacguggagcucauccgcgggcggaaggaggagaccgaggugcuguggaccagcaacuccaucgucguguucugcggcaccagcgggacguacggcaccggguccuggccggacggcgccgacaucaaccugaugcccaucuga

SEQ ID NO: 28501 - RNA, 1410 nt, Artificial Sequence
  derived and/or modified CDS sequence (AUadapt) from InfluenzaA__BAF47987__NA
augaaccccaaccagaagaucaucaccaucggcucggugucccugaccaucagcacgaucugcuucuucaugcagaucgccauccucaucaccaccgucacccugcacuucaagcaguacgaguucaacuucccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucucgaaggacaacuccauccgccugagcgccggcggggacaucugggucacccgggagcccuacguguccugcgaccccgacaagugcuaccaguucgcccucggccaggggaccacgcugaacaacgugcacagcaacgacaagguccacgaccgcaccccguaccggacccugcucaugaacgagcugggcgugcccuuccaccugggcaccaagcaggucugcaucgccugguccucguccagcugccacgacgggaaggccuggcuccacgugugcgugacgggcgacgacaagaacgcgaccgccuccuucaucuacaacgggcgccugguggacagcaucgucuccuggucgaagaagauccugcggacccaggaguccgagugcgugugcaucaacgggaccugcacgguggucaugaccgacgggagcgccuccggcaaggccgacaccaagauccucuucaucgaggagggcaagaucgugcacaccucgacgcugagcggguccgcgcagcacguggaggagugcagcugcuacccccgcuaccccggcguccggugcgugugccgcgacaacuggaagggguccaaccggccgaucguggacaucaacaucaaggacuacucgaucgucuccagcuacgugugcuccggccuggugggcgacacgccccgcaagaacgacagcuccucguccagccacugccucgaccccaacaacgaggagggcggccacggggucaagggcugggccuucgacgacgggaacgacguguggaugggccggaccaucuccgagaagcugcgcucgggcuacgagaccuucaaggucaucgaggggugguccaaccccaacagcaagcugcagaucaaccgccaggugaucguggaccggggcaaccgguccggguacagcggcaucuucuccgucgagggcaagucgugcaucaaccgcugcuucuacguggagcucauccgggggcgcaaggaggagaccgaggugcuguggaccagcaacuccaucgucguguucugcggcaccagcgggaccuacggcacgggguccuggccggacggcgccgacaucaaccugaugcccaucuga

SEQ ID NO: 28502 - RNA, 1410 nt, Artificial Sequence; identical to SEQ ID NO: 17116
  derived and/or modified CDS sequence (AUadapt) from InfluenzaA__BAF47988__NA

SEQ ID NO: 28503 - RNA, 1410 nt, Artificial Sequence; identical to SEQ ID NO: 17116
  derived and/or modified CDS sequence (AUadapt) from InfluenzaA__BAF47989__NA

SEQ ID NO: 28504 - RNA, 1410 nt, Artificial Sequence
  derived and/or modified CDS sequence (AUadapt) from InfluenzaA__BAF47990__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccgugaucaugaccgacggguccgccagcggcaaggccgacaccaagauccucuucaucgaggagggcaagaucguccacacgucgacccuguccgggagcgcgcagcacguggaggagugcuccugcuacccccgcuaccccggcgugcggugcgucugccgcgacaacuggaaggggucgaaccggccgaucguggacaucaacaucaaggacuacuccaucgugagcuccuacgucugcucgggccuggugggcgacacgccccgcaagaacgacuccagcuccagcucccacugccucgaccccaacaacgaggagggcgggcacggggugaagggcugggccuucgacgacgggaacgacgucuggaugggccggaccgugucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 28505 - RNA, 1410 nt, Artificial Sequence
  derived and/or modified CDS sequence (AUadapt) from InfluenzaA__BAF47991__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaucguccacgaccgcaccccguaccggacccugcucaugaacgagcugggcgugcccuuccaccugggcaccaagcaggucugcaucgccuggucguccagcuccugccacgacgggaaggccuggcuccacgugugcgugacgggcgacgacaagaacgcgaccgccucguucaucuacaacgggcgccugguggacuccaucgucagcugguccaagaagauccugcggacccaggagagcgagugcgugugcaucaacgggaccugcacgguggucaugaccgacggguccgccucgggcaaggccgacaccaagauccucuucaucgaggagggcaagaucgugcacaccagcacgcuguccgggucggcgcagcacguggaggagugcuccugcuacccccgcuaccccggcauccggugcgucugccgcgacaacuggaaggggagcaaccggccgaucguggacaucaacaucaaggacuacuccaucgugagcuccuacgucugcucgggccuggugggcgacacgccccgcaagaacgacuccagcuccucgucccacugccucgaccccaacaacgaggagggcggccacggggugaagggcugggccuucgacgacgggaacgacgucuggaugggccggaccaucagcgagaagcugcgcuccggcuacgagaccuucaaggugaucgagggguggagcaaccccaacuccaagcugcagaucaaccggcaggucaucguggaccgcggcaaccggucgggguacuccggcaucuucagcguggagggcaagucgugcaucaaccgcugcuucuacgucgagcucauccgggggcgcaaggaggagaccgaggugcuguggaccuccaacagcaucguggucuucugcggcaccuccgggaccuacggcacggggagcuggccggacggcgccgacaucaaccugaugcccaucuga

SEQ ID NO: 28506 - RNA, 1410 nt, Artificial Sequence
  derived and/or modified CDS sequence (AUadapt) from InfluenzaA__BAF47992__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugagcugcgagcccgacaagugcuacccguucgcccucgugcagggcaccacgcugaacaacguccacuccaacgacaccgugcacgaccgcacccccuaccggacccugcucaugaacgagcugggggugcccuuccaccugggcacgaagcaggucugcaucgccuggucguccagcuccugccacgacggcaaggccuggcuccacgugugcgugaccggggacgacaagaacgcgaccgccagcuucaucuacaacggccgccuggucgacuccaucgugucgugguccaaggagauccugcggacccaggagagcgagugcgugugcaucaacgggacgugcaccgucgugaugaccgacggcuccgccucggggaaggccgacaccaagauccucuucaucgaggagggcaagaucgugcacacgagcacccuguccggcagcgcgcagcacgucgaggagugcuccugcuacccccgcuacccgggggugcggugcgugugccgcgacaacuggaagggcucgaaccggcccaucgucgacaucaacaucaaggacuacuccaucgugagcuccuacgugugcagcgggcuggucggcgacacgccccgcaagaacgacuccucguccagcggccacugccucgaccccaacaacgaggagggcgggcacggggugaagggcugggccuucgacgacgggaacgacgucuggaugggccggaccaucuccgagaagcugcgcucgggcuacgagaccuucaaggugaucgaggggugguccaacccgaacagcaagcugcagaucaaccgccaggugaucgucgaccggggcaaccgguccggguacagcggcaucuucuccguggagggcaagucgugcaucaaccgcugcuucuacguggagcucauccgggggcgcaaggaggagaccgagguccuguggaccagcaacuccuucgugguguucugcggcaccagcgggacguacggcaccggguccuggcccgacggcgccgacaucaaccugaugcccaucuga

SEQ ID NO: 28507 - RNA, 1410 nt, Artificial Sequence; identical to SEQ ID NO: 28463
  derived and/or modified CDS sequence (AUadapt) from InfluenzaA__BAF47993__NA

SEQ ID NO: 28508 - RNA, 1410 nt, Artificial Sequence; identical to SEQ ID NO: 17114
  derived and/or modified CDS sequence (AUadapt) from InfluenzaA__BAF47994__NA

SEQ ID NO: 28509 - RNA, 1410 nt, Artificial Sequence
  derived and/or modified CDS sequence (AUadapt) from InfluenzaA__BAF47995__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacggccgcaccccguaccggacccugcucaugaacgagcugggcgugcccuuccaccuggggacgaagcaggucugcaucgccuggagcuccucguccugccacgacggcaaggccuggcuccacgugugcgugaccggggacgacaagaacgcgaccgccagcuucaucuacaacggccgccugguggacuccaucgucagcugguccaaggagauccugcggacccaggagucggagugcgugugcaucaacgggacgugcaccguggucaugaccgacggcuccgccagcggcaaggccgacaccaagauccucuucaucgaggaggggaagaucgugcacacgucgacccuguccggcagcgcgcagcacguggaggagugcuccugcuacccccgcuaccccgggguccggugcgugugccgcgacaacuggaagggcucgaaccggccgaucguggacaucaacaucaaggacuacuccaucgucagcuccuacgugugcucgggccuggugggggacacgccccgcaagaacgacuccagcuccagcucccacugccucgaccccaacaacgaggagggcgggcacggcgucaaggggugggccuucgacgacggcaacgacguguggaugggccggaccaucucggagaagcugcgcuccggguacgagaccuucaaggucaucgagggcuggagcaaccccaacuccaagcugcagaucaaccgccaggugaucguggaccgggggaaccggucgggcuacuccgggaucuucagcgucgagggcaagucgugcaucaaccgcugcuucuacguggagcucauccggggccgcaaggaggagaccgaggugcuguggaccuccaacagcaucgucguguucugcgggaccuccggcacguacgggaccggcagcuggccggacggggccgacaucaaccugaugcccaucuga

SEQ ID NO: 28510 - RNA, 1410 nt, Artificial Sequence; identical to SEQ ID NO: 28509
  derived and/or modified CDS sequence (AUadapt) from InfluenzaA__BAF47996__NA

SEQ ID NO: 28511 - RNA, 1410 nt, Artificial Sequence; identical to SEQ ID NO: 17116
  derived and/or modified CDS sequence (AUadapt) from InfluenzaA__BAF47997__NA

SEQ ID NO: 28512 - RNA, 1410 nt, Artificial Sequence
  derived and/or modified CDS sequence (AUadapt) from InfluenzaA__BAF57504__NA
augaaccccaaccagaagaucaucaccaucggcucggugucccugaccaucagcacgaucugcuucuucaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccccagugcaacaucaccggguucgcgcccuucucgaaggacaacuccauccgccugagcgccggcggggacaucugggucacccgggagcccuacguguccucggacccggacaagugcuaccaguucgcccucggccaggggaccacgcugaacaacgugcacuccaacgacaccguccacgaccgcacccccuaccggacccugcucaugaaggagcugggcgugcccuuccaccugggcacgaagcaggucugcaucgccuggagcuccucguccugccacgacgggaaggccuggcuccacgugugcgugaccggcgacgacgagaacgcgaccgccagcuucaucuacaacgggcgccugguggacuccgucgugagcugguccaagaagauccugcggacccaggagucggagugcgugugcaucaacggcacgugcaccgucgugaugaccgacggguccgccagcggcaaggccgacaccaagauccucuucaucgaggagggcaagaucgugcacacgucgucccugagcggguccgcgcagcacgucgaggagugcucgugcuacccccgcuacccgggcgugcggugcgugugccgcgacaacuggaagggguccaaccggcccaucgucgacaucaacaucaaggacuacagcaucguguccucguacgugugcuccggccuggucggcgacacgccccgcaagaacgacagcuccagcuccucgcacugccucgaccccaacaacgaggagggcgggcacggggugaagggcugggccuucgacgacgggaacgacgucuggaugggccggaccaucuccgagaagcugcgcagcggcuacgagaccuucaaggugaucgaggggugguccaacccgaacucgaagcugcagaucaaccgccaggugaucgucgaccggggcaaccgguccggguacagcggcaucuucucgguggaggggaaguccugcaucaaccgcugcuucuacguggagcucauccggggccgcaagcaggagaccgagguccuguggaccagcaacuccaucgugguguucugcggcaccagcgggaccuacggcacgggguccuggcccgacggcgccgacaucaaccugaugcccaucuga

SEQ ID NO: 28513 - RNA, 1410 nt, Artificial Sequence
  derived and/or modified CDS sequence (AUadapt) from InfluenzaA__BAF57508__NA
augaaccccaaccagaagaucaucaccaucggcucggugucccugaccaucagcacgaucugcuucuucaugcagaucgccauccucaucaccacccugacccugcacuucaagcaguacgaguucaacuccccgcccaacaaccaggucaugcucugcgagcccacgaucaucgagcgcaacaucaccgagaucguguaccugaccaacaccacgaucgagaaggagaucugccccaagcuggccgaguaccggaacuggucgaagccgcagugcaacaucaccggguucgcgcccuucuccaaggacaacagcauccgccucuccgccggcggggacaucugggugacccgggagcccuacgucucgugcgaccccgacaagugcuaccaguucgcccugggccaggggaccacgcugaacaacgugcacuccaacgacaccgugcacgaccgcaccccguaccggacccuccugaugaacgagcugggcguccccuuccaccucggcacgaagcaggucugcaucgccuggagcuccucguccugccacgacgggaaggccuggcugcacgugugcgugaccggcgacgacgagaacgcgaccgccagcuucaucuacaacgggcgccugguggacuccaucgugagcugguccaagaagauccuccggacccaggagucggagugcgucugcaucaacggcacgugcaccguggugaugaccgacggguccgccagcggcaaggccgacaccaagauccuguucaucgaggagggcaagaucguccacacgucgacccuguccgggagcgcgcagcacguggaggagugcuccugcuacccccgcuaccccggcgugcggugcgucugccgcgacaacuggaaggggucgaaccggccgaucguggacaucaacaucaaggacuacuccaucgugagcuccuacgucugcucgggccucgugggcgacacgccccgcaagaacgacuccagcuccagcucccacugccuggaccccaacaacgaggagggcgggcacggggugaagggcugggccuucgacgacgggaacgacgucuggaugggccggaccaucucggagaagcugcgcuccggcuacgagaccuucaaggugaucgagggguggagcaaccccaacuccaagcuccagaucaaccggcaggucaucguggaccgcggcaaccggucgggguacuccggcaucuucagcguggagggcaagucgugcaucaaccgcugcuucuacgucgagcugauccgggggcgcaagcaggagaccgaggugcuguggaccuccaacagcaucguggucuucugcggcaccuccgggacguacggcaccgggagcuggccggacggcgccgacaucaaccucaugcccaucuga

SEQ ID NO: 28514 - RNA, 1410 nt, Artificial Sequence; identical to SEQ ID NO: 18331
  derived and/or modified CDS sequence (AUadapt) from InfluenzaA__BAF57511__NA

SEQ ID NO: 28515 - RNA, 1410 nt, Artificial Sequence
  derived and/or modified CDS sequence (AUadapt) from InfluenzaA__BAF57515__NA
augaaccccaaccagcgcaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcggaacaucaccgagaucguguaccucaccaacaccacgaucgagaaggagaucugccccaagcuggccgaguaccgcaacuggucgaagccgcagugcaacaucaccggguucgcgcccuucuccaaggacaacagcauccggcuguccgccggcggggacaucugggucacccgcgagcccuacgugucgugcgaccccgacaagugcuaccaguucgcccucggccaggggaccacgcugaacaacgugcacuccaacgacaagguccacgaccggaccccguaccgcacccugcucaugaacgagcugggcgugcccuuccaccugggcaccaagcaggucugcaucgccuggagcuccucguccugccacgacgggaaggccuggcuccacgugugcgugacgggcgacgacgagaacgcgaccgccagcuucaucuacaacgggcggcugguggacuccaucgucagcugguccaagaagauccugcgcacccaggagucggagugcgugugcaucaacgggaccugcacgguggucaugaccgacggguccgccagcggcaaggccgacaccaagauccucuucaucgaggagggcaagaucgugcacaccucgacgcuguccgggagcgcgcagcacguggaggagugcuccugcuacccccgguaccccggcguccgcugcgugugccgggacaacuggaaggggucgaaccgcccgaucguggacaucaacaucaaggacuacuccaucgucagcuccuaccugugcucgggccucgugggcgacacgccccggaagaacgacuccagcuccagcucccacugccuggaccccaacaacgaggagggcggccacggggugaagggcugggccuucgacgacgggaacgacgucuggaugggccgcaccaucucggagaagcugcgguccggcuacgagaccuucaaggugaucgagggguggagccaccccaacucccagcuccagaucaaccgccaggucaucguggaccggggcaaccgcucgggguacuccggcaucuucagcguggagggcaagucgugcaucaaccggugcuucuacgucgagcugauccgcgggcggaagcaggagaccgaggugcuguggaccuccaacagcaucguggucuucugcggcaccuccgggaccuacggcacggggagcuggccggacggcgccgacaucaaccucaugcccaucuga

SEQ ID NO: 28516 - RNA, 1410 nt, Artificial Sequence
  derived and/or modified CDS sequence (AUadapt) from InfluenzaA__BAF57522__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccaucaucgagaaggagaucugccccaagcuggccgaguaccggaacuggucgaagccgcagugcaacaucacgggguucgcgcccuucuccaaggacaacagcauccgccuguccgccggcggggacaucugggucacccgggagcccuacgugucgugcgaccccgacaagugcuaccaguucgcccucggccaggggaccacccugaacaacgugcacuccaacgacacgguccacgaccgcaccccguaccggacccugcucaugaacgagcugggcgugcccuuccaccugggcaccaagcaggucugcaucgccuggagcuccucguccugccacgacgggaaggccuggcuccacgugugcgugacgggcgacgacgagaacgcgaccgccagcuucaucuacaacgggcgccugguggacuccaucgucucgugguccaagaagauccugcggacccaggagagcgagugcgugugcaucaacgggaccugcacgguggucaugaccgacggguccgccucgggcaaggccgacaccaagauccucuucaucgaggagggcaagaucgugcacaccagcacgcuguccgggucggcgcagcacguggaggagugcuccugcuacccccgcuaccccggcguccggugcgugugccgcgacaacuggaaggggagcaaccggccgaucguggacaucaacaucaaggacuacuccaucgucucguccuacgugugcagcggccuggugggcgacacgccccgcaagaacgaccggucccgcucgucccacugccucgaccccaacaacgaggagggcggccacggggucaagggcugggccuucgacgacgggaacgacguguggaugggccggaccaucagcgagaagcugcgcuccggcuacgagaccuucaaggucaucgagggguggucgaagcccaacuccaagcugcagaucaaccgccaggugaucguggaccggggcaaccggaccggguacagcggcaucuucuccgucgagggcaagucgugcaucaaccgcugcuucuacguggagcucauccgggggcgcaagcaggagaccgaggugcuguggaccuccaacagcaucgucguguucugcggcaccagcgggacguacggcaccggguccuggccggacggcgccgacaucaaccugaugcccaucuga

SEQ ID NO: 28517 - RNA, 1410 nt, Artificial Sequence
  derived and/or modified CDS sequence (AUadapt) from InfluenzaA__BAF57529__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaagguccacgagcgcaccccguaccggacccugcucaugaacgagcugggcgugcccuuccaccugggcaccaagcaggucugcaucgccuggagcuccucguccugccacgacgggaaggccuggcuccacgugugcgugacgggcgacgacaagaacgcgaccgccagcuucaucuacaacgggcgccugguggacuccaucgucagcugguccaagaagauccugcggacccaggagucggagugcgugugcaucaacgggaccugcacgguggucaugaccgacggguccgccagcggcaaggccgacaccaagauccucuucaucgaggagggcaagaucgugcacaccucgacgcuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcggccacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggaccuacggcacggggagcuggccggacggcgccgacaucaaccugaugcccaucuga

SEQ ID NO: 28518 - RNA, 1410 nt, Artificial Sequence; identical to SEQ ID NO: 23953
  derived and/or modified CDS sequence (AUadapt) from InfluenzaA__BAF57532__NA

SEQ ID NO: 28519 - RNA, 1410 nt, Artificial Sequence; identical to SEQ ID NO: 23953
  derived and/or modified CDS sequence (AUadapt) from InfluenzaA__BAF57536__NA

SEQ ID NO: 28520 - RNA, 1410 nt, Artificial Sequence
  derived and/or modified CDS sequence (AUadapt) from InfluenzaA__BAF57539__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugaucgacuccaucgugagcugguccaagaagauccugcggacccaggagucggagugcgucugcaucaacggcacgugcaccguggugaugaccgacggguccgccagcggcaaggccgacaccaagauccucuucaucgaggagggcaagaucguccacacgucgacccuguccgggagcgcgcagcacguggaggagugcuccugcuacccccgcuaccccggcgugcggugcgucugccgcgacaacuggaaggggucgaaccggccgaucguggacaucaacaucaaggacuacuccaucgugagcuccuacgucugcucgggccuggugggcgacacgccccgcaagaacgacuccagcuccagcucccacugccucgaccccaacaacgaggagggcgggcacggggugaagggcugggccuucgacgacgggaacgacgucuggaugggccggaccaucucggagaagcugcgcuccggcuacgagaccuucaaggugaucgagggguggagcaaccccaacuccaagcugcagaucaaccggcaggucaucguggaccgcggcaaccggucgggguacuccggcaucuucagcguggagggcaagucgugcaucaaccgcugcuucuacgucgagcucauccgggggcgcaaggagaagaccgaggugcuguggaccuccaacagcaucguggucuucugcggcaccuccgggacguacggcaccgggagcuggccggacggcgccgacaucaaccugaugcccaucuga

SEQ ID NO: 28521 - RNA, 1410 nt, Artificial Sequence
  derived and/or modified CDS sequence (AUadapt) from InfluenzaA__BAF57543__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaagaagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccgccaucuucagcgucgagggcaagucgugcaucaaccgcugcuucuacguggagcucauccgggggcgcaaggaggagaccgaggugcuguggaccuccaacagcaucgucguguucugcggcaccuccggcacguacgggaccggcagcuggccggacggggccgacaucaaccugaugcccaucuga

SEQ ID NO: 28522 - RNA, 1410 nt, Artificial Sequence
  derived and/or modified CDS sequence (AUadapt) from InfluenzaA__BAF57547__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaagaagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggcccuguggaccuccaacagcaucguggucuucugcggcaccuccgggacguacggcaccgggagcuggccggacggcgccgacaucaaccugaugcccaucuga

SEQ ID NO: 28523 - RNA, 1410 nt, Artificial Sequence; identical to SEQ ID NO: 17116
  derived and/or modified CDS sequence (AUadapt) from InfluenzaA__BAF57551__NA

SEQ ID NO: 28524 - RNA, 1410 nt, Artificial Sequence; identical to SEQ ID NO: 17116
  derived and/or modified CDS sequence (AUadapt) from InfluenzaA__BAF57555__NA

SEQ ID NO: 28525 - RNA, 1410 nt, Artificial Sequence; identical to SEQ ID NO: 17114
  derived and/or modified CDS sequence (AUadapt) from InfluenzaA__BAF57559__NA

SEQ ID NO: 28526 - RNA, 1410 nt, Artificial Sequence
  derived and/or modified CDS sequence (AUadapt) from InfluenzaA__BAF57563__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaucguccacgaccgcaccccguaccggacccugcucaugaacgagcugggcgugcccuuccaccugggcaccaagcaggucugcaucgccuggucguccagcuccugccacgacgggaaggccuggcuccacgugugcgugacgggcgacgacaagaacgcgaccgccucguucaucuacaacgggcgccugguggacuccaucgucagcugguccaaggagauccugcggacccaggagagcgagugcgugugcaucaacgggaccugcacgguggucaugaccgacggguccgccucgggcaaggccgacaccaagauccucuucaucgaggagggcaagaucgugcacaccagcacgcuguccgggucggcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcucgggccuggugggcgacacgccccgcaagaacgacuccagcuccucgucccacugccucgaccccaacaacgaggagggcggccacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggaccuacggcacggggagcuggccggacggcgccgacaucaaccugaugcccaucuga

SEQ ID NO: 28527 - RNA, 1410 nt, Artificial Sequence; identical to SEQ ID NO: 17114
  derived and/or modified CDS sequence (AUadapt) from InfluenzaA__BAF57571__NA

SEQ ID NO: 28528 - RNA, 1410 nt, Artificial Sequence; identical to SEQ ID NO: 23858
  derived and/or modified CDS sequence (AUadapt) from InfluenzaA__BAF57575__NA

SEQ ID NO: 28529 - RNA, 1410 nt, Artificial Sequence; identical to SEQ ID NO: 16729
  derived and/or modified CDS sequence (AUadapt) from InfluenzaA__BAF57579__NA

SEQ ID NO: 28530 - RNA, 1410 nt, Artificial Sequence
  derived and/or modified CDS sequence (AUadapt) from InfluenzaA__BAF57583__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacauccgggucacccgcgagcccuacgugucgugcgaccccgacaagugcuaccaguucgcccucggccaggggaccacgcugaacaacgugcacuccaacgacaccguccacgaccggaccccguaccgcacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcggcugguggacuccaucgucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggacuacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagcugcgguccggcuacgagaccuucaaggucaucgagggguggagcaaccccaacuccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 28531 - RNA, 1410 nt, Artificial Sequence
  derived and/or modified CDS sequence (AUadapt) from InfluenzaA__BAF57587__NA
augaaccccaaccagaagaucaucaccaucggcucggugucccugaccaucagcacgaucugcuucuucaugcagaucgccauccucaucaccaccgucacccugcacuucaagcagugcgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 28532 - RNA, 1410 nt, Artificial Sequence
  derived and/or modified CDS sequence (AUadapt) from InfluenzaA__BAF57591__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccucguucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucgugcacaucaacaucaaggacuacuccaucgucucguccuacgugugcagcggccuggugggcgacacgccccgcaagaacgacuccucguccagcucccacugccucaaccccaacaacgaggagggcgggcacggggucaagggcugggccuucgacgacgggaacgacguguggaugggccggaccaucagcgagaagcugcgccugggcuacgagaccuucaaggucaucgaggggugguccaaccccaacucgaagcuccagaucaaccgccaggugaucguggaccggggcaaccgguccggguacagcggcaucuucuccgucgagggcaagucgugcaucaaccgcugcuucuacguggagcugauccgggggcgcaaggaggagaccgaggugcuguggaccagcaacuccaucgucguguucugcggcaccagcgggacguacggcaccggguccuggccggacggcgccgacaucaaccucaugcccaucuga

SEQ ID NO: 28533 - RNA, 1410 nt, Artificial Sequence
  derived and/or modified CDS sequence (AUadapt) from InfluenzaA__BAF57595__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagaucgccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccugggccaggggaccacgcucaacaacgugcacuccaacgacaccguccacgaccgcaccccguaccggacccugcugaugaacgagcucggcgugcccuuccaccugggcacgaagcaggucugcaucgccuggagcuccucguccugccacgacgggaaggccuggcugcacgugugcgugaccggcgacgacaagaacgcgaccgccagcuucaucuacaacgggcgccucguggacuccaucgucagcugguccaaggagauccugcggacccaggagucggagugcgugugcgugaacggcacgugcaccgucgugaugaccgacggguccgccagcggcaaggccgacaccaagauccuguucaucgaggagggcaagaucgugcacacgucgacccucuccgggagcgcgcagcacgucgaggagugcuccugcuacccccgcuaccccggcgugcggugcgugugccgcgacaacuggaaggggucgaaccggccgaucgucgacaucaacaucaaggacuacuccaucgugagcuccuacgugugcucgggccuggucggcgacacgccccgcaagaacgacuccagcuccagcucccacugccuggaccccaacaacgaggagggcgggcacggggugaagggcugggccuucgacgacgggaacgacgucuggaugggccggaccaucucggagaagcuccgcuccggcuacgagaccuucaaggugaucgagggguggagcaaccccaacuccaagcugcagaucaaccgccaggugaucgucgaccggggcaaccggucgggguacuccggcaucuucagcguggagggcaagucgugcaucaaccgcugcuucuacguggagcugauccgggggcgcaaggaggagaccgagguccucuggaccuccaacagcaucgugguguucugcggcaccuccgggacguacggcaccgggagcuggccggacggcgccgacaucaaccugaugcccaucuga

SEQ ID NO: 28534 - RNA, 1410 nt, Artificial Sequence; identical to SEQ ID NO: 23858
  derived and/or modified CDS sequence (AUadapt) from InfluenzaA__BAF57599__NA

SEQ ID NO: 28535 - RNA, 1410 nt, Artificial Sequence
  derived and/or modified CDS sequence (AUadapt) from InfluenzaA__BAF57603__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccgacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcugggcaccuccaacagcaucgucguguucugcgggaccuccggcacguacgggaccggcagcuggccggacggggccgacaucaaccugaugcccaucuga

SEQ ID NO: 28536 - RNA, 1410 nt, Artificial Sequence; identical to SEQ ID NO: 23953
  derived and/or modified CDS sequence (AUadapt) from InfluenzaA__BAF62620__NA

SEQ ID NO: 28537 - RNA, 1413 nt, Artificial Sequence
  derived and/or modified CDS sequence (AUadapt) from InfluenzaA__BAF63036__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucacgaucaacaacaccaacgugguggcggggaaggacaagaccucggucacccuggccggcaacuccagccugugcuccaucagcggcugggccaucuacacgaaggacaacuccauccggaucgggucgaagggcgacguguucgugauccgcgagccguucaucuccugcagccaccucgagugccggaccuucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucacgaucgggaucagcggccccgacaacggggcgguggccguccugaaguacaacggcaucaucaccgagaccaucaaguccuggaagaagcgcauccugcggacccaggagucggagugcgugugcgugaacggcuccugcuucacgaucaugaccgacgggcccagcaacggcgccgccuccuacaagaucuucaagaucgagaaggggaaggucaccaagucgaucgagcucaacgcccccaacuuccacuacgaggagugcuccugcuacccggacaccggcacggugaugugcgugugccgcgacaacuggcacgggagcaaccggcccugggucuccuucaaccagaaccuggacuaccagaucggcuacaucugcucgggcguguucggggacaacccccgccccaaggacggcaagggguccugcaacccggugaccgucgacggcgcggacggggugaagggcuucagcuacaaguacggcaacgggguguggaucggccggaccaaguccaaccgccugcggaagggguucgagaugaucugggaccccaacggcuggaccgacacggacagcgacuucuccgucaagcaggacgugguggccaucaccgacuggucgggguacagcggcuccuucguccagcaccccgagcucaccggccuggacugcauccgccccugcuucuggguggagcugguccgggggcucccgcgcgagaacaccacgaucuggaccucgggcuccagcaucuccuucugcggggugaacagcgacaccgccaacugguccuggcccgacggcgccgagcugcccuucaccaucgacaaguga

SEQ ID NO: 28538 - RNA, 1413 nt, Artificial Sequence; identical to SEQ ID NO: 23843
  derived and/or modified CDS sequence (AUadapt) from InfluenzaA__BAF63040__NA

SEQ ID NO: 28539 - RNA, 1413 nt, Artificial Sequence
  derived and/or modified CDS sequence (AUadapt) from InfluenzaA__BAF63047__NA
augaaccccaaccagaagaucaucaccaucggcucgaucuccaucgccaucgggaucaucagccuggugcuccagaucggcaacaucaucuccaucugggccucgcacuccauccagaccgggagccagaaccacacgggcaucugcaaccagcgcaucaucaccuacgagaacuccaccugggucaaccacaccuacgugaacaucaacaacacgaacguggucgcggggaaggacaagaccucggugacccuggccggcaacuccagccugugcuccaucagcggcugggccaucuacaccaaggacaacuccauccggaucgggucgaagggcgacguguucgucauccgcgagccguucaucuccugcagccaccucgagugccggacguucuuccugacccagggggcccugcucaacgacaagcacuccaacggcaccgugaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcggucgccgugcugaaguacaacggcaucaucacggagaccaucaaguccuggaagaagcgcauccugcggacccaggagucggagugcgugugcgucaacggcuccugcuucaccaucaugacggacgggcccagcaacggcgccgccuccuacaagaucuucaagaucgagaaggggaaggugaccaagucgaucgagcucaacgcccccaacuuccacuacgaggagugcuccugcuacccggacaccggcaccgugaugugcgucugccgcgacaacuggcacgggagcaaccggcccuggguguccuucaaccagaaccuggacuaccagaucggcuacaucugcucgggcguguucggggacaacccccgccccaaggacggcgagggguccugcaacccggucacgguggacggcgcggacggggugaagggcuucagcuacaaguacggcaacggggucuggaucggccggaccaaguccaaccgccugcggaagggguucgagaugaucugggaccccaacggcuggaccgacaccgacagcgacuucuccgugaagcaggacguggucgccaucacggacuggucgggguacagcggcuccuucgugcagcaccccgagcucaccggccuggacugcauccgccccugcuucugggucgagcuggugcgggggcucccgcgcgagaacaccaccaucuggacgucgggcuccagcaucuccuucugcggggugaacagcgacaccgccgacugguccuggcccgacggcgccgagcugcccuucaccaucgacaaguga

SEQ ID NO: 28540 - RNA, 1413 nt, Artificial Sequence
  derived and/or modified CDS sequence (AUadapt) from InfluenzaA__BAF63058__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcgccaucuccggcugggccaucuacaccaaggacaacucgauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcgcugaugagcugcccccugggggaggcccccuccccguacaacucgaaguucgagagcguggccugguccgccagcgcgugccacgacggcaugggcuggcucaccaucgggaucuccggccccgacaacggggccguggccguccugaaguacaacggcaucaucacggagaccaucaagucguggaagaagcgcauccugcggacccaggaguccgagugcgugugcgugaacggcagcugcuucaccaucaugacggacgggcccuccaacgaggccgccucguacaagaucuucaagaucgagaagggcaaggucaccaaguccaucgagcucaacgcgcccaacuuccacuacgaggagugcagcugcuacccggacaccgggaccgugaugugcgugugccgcgacaacuggcacggcuccaaccggcccugggucucguucaaccccaaccuggacuaccagaucggguacaucugcuccggcguguucggcgacaacccccgcccgaaggacggggagggcagcugcaaccccgugacggucgacggggccgacggcgugaagggguucuccuacaaguacggcaacggcguguggaucgggcggaccaagucgaaccgccugcggaagggcuucgagauggucugggaccccaacggguggaccgacaccgacuccgacuucagcgugaagcaggacguggucgccaucacggacugguccggcuacucggggagcuucgugcagcaccccgagcucaccggccuggacugcauccgcccgugcuucugggucgagcuggugcggggccuccccaaggagaacaccaccaucuggacguccgggucguccaucagcuucugcggcgugaacuccgacaccgccaacuggagcuggcccgacggggccgagcugcccuucaccaucgacaaguga

SEQ ID NO: 28541 - RNA, 1413 nt, Artificial Sequence; identical to SEQ ID NO: 23843
  derived and/or modified CDS sequence (AUadapt) from InfluenzaA__BAF63065__NA

SEQ ID NO: 28542 - RNA, 1413 nt, Artificial Sequence; identical to SEQ ID NO: 23843
  derived and/or modified CDS sequence (AUadapt) from InfluenzaA__BAF63069__NA

SEQ ID NO: 28543 - RNA, 1413 nt, Artificial Sequence; identical to SEQ ID NO: 23843
  derived and/or modified CDS sequence (AUadapt) from InfluenzaA__BAF63079__NA

SEQ ID NO: 28544 - RNA, 1413 nt, Artificial Sequence; identical to SEQ ID NO: 23843
  derived and/or modified CDS sequence (AUadapt) from InfluenzaA__BAF63092__NA

SEQ ID NO: 28545 - RNA, 1413 nt, Artificial Sequence; identical to SEQ ID NO: 23843
  derived and/or modified CDS sequence (AUadapt) from InfluenzaA__BAF63098__NA

SEQ ID NO: 28546 - RNA, 1413 nt, Artificial Sequence
  derived and/or modified CDS sequence (AUadapt) from InfluenzaA__BAF63104__NA
augaaccccaaccagaagaucaucaccaucggcucgaucuccaucgccaucgggaucaucagccugaugcuccaggugggcaucgucguguccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucgcccuggccggcaacuccucgcugugcuccaucagcggcugggccaucuacaccaaggacaacuccauccggaucgggucgaagggcgacguguucgugauccgcgagccguucaucuccugcagccaccucgagugccggaccuucuuccugacgcagggggcccugcucaacgacaagcacuccaacggcaccgucaaggaccgcagccccuaccgggcgcugauguccugcccccugggggaggcccccucgccguacaacagcaaguucgaguccguggccuggagcgccuccgcgugccacgacggcaugggcuggcucaccaucgggaucucgggccccgacaacggggccguggccguccugaaguacaacggcaucaucaccgagacgaucaaguccuggaagaagcgcauccugcggacccaggagagcgagugcgugugcgugaacggcuccugcuucaccaucaugaccgacgggcccucgaacggcgccgccuccuacaagaucuucaagaucgagaaggggcaggucaccaagagcguggagcucaacgcgcccaacuuccacuacgaggagugcuccugcuacccggacacgggcaccgugaugugcgucugccgcgacaacuggcacgggagcaaccggcccuggguguccuucaaccagaaccuggacuaccagaucggcuacaucugcucgggcguguucggggacaacccccgccccaaggacggcaagggguccugcaacccggucaccguggacggcgccgacggggugaagggcuucagcuacaaguacggcaacggggucuggaucggccggacgaaguccaaccgccugcggaagggguucgagaugaucugggaccccaacggcuggaccgacaccgacucggacuucuccgugaagcaggacgucguggccaucaccgacuggagcggguacagcggcuccuucgugcagcaccccgagcucacgggccuggacugcauccgccccugcuucugggucgagcuggugcgggggcucccgcgcgagaacaccaccaucuggaccucgggcuccagcaucuccuucugcgggguggacagcgacacggccaacugguccuggcccgacggcgccgagcugcccuucaccaucgacaaguga

SEQ ID NO: 28547 - RNA, 1413 nt, Artificial Sequence
  derived and/or modified CDS sequence (AUadapt) from InfluenzaA__BAF63112__NA
augaaccccaaccagaagaucaucaccaucggcucgaucuccaucgccaucgggaucaucagccugaugcuccaggugggcaacaucaucuccaucugggccucgcacuccauccagaccgggagccagaaccacacgggcaucugcaaccagcgcaucaucaccuacgagaacuccaccugggucaaccacaccuacgugaacaucaacaacacgaacguggucgcggggaaggacaagaccucgguggcccuggccggcaacuccagccugugcuccaucagcggcugggccaucuacaccaaggacaacuccauccggaucgggucgaagggcgacguguucgucauccgcgagccguucaucuccugcagccaccucgagugccggaccuucuuccugacgcagggggcccugcucaacgacaagcacuccaacggcaccgugaaggaccgcucgcccuaccgggcgcugauguccugcccccugggggaggcccccagcccguacaacucgaaguucgaguccguggccuggagcgccuccgcgugccacgacggcaugggcuggcucaccaucgggaucagcggccccgacaacggggccgucgccgugcugaaguacaacggcaucaucaccgagacgaucaaguccuggaagaagcgcauccugcggacccaggagucggagugcgugugcgucaacggcuccugcuucaccaucaugaccgacgggcccagcaacggcgccgccuccuacaagaucuucaagaucgagaagggccaggugaccaagucgguggagcucaacgcgcccaacuuccacuacgaggagugcuccugcuacccggacacggggaccgucaugugcgugugccgcgacaacuggcacgggagcaaccggcccuggguguccuucaaccagaaccuggacuaccagaucggcuacaucugcucgggcgucuucggggacaacccccgccccaaggacggcaagggguccugcaacccggugaccguggacggcgccgacggggucaagggcuucagcuacaaguacggcaacgggguguggaucggccggacgaaguccaaccgccugcggaagggguucgagaugaucugggaccccaacggcuggaccgacaccgacagcgacuucuccgugaagcaggacgucguggccaucaccgacuggucgggguacagcggcuccuucguccagcaccccgagcucacgggccuggacugcauccgccccugcuucuggguggagcuggugcgggggcucccgcgcgagaacaccaccaucuggaccucgggcuccagcaucuccuucugcggggucgacagcgacacggccaacugguccuggcccgacggcgccgagcugcccuucaccaucgacaaguga

SEQ ID NO: 28548 - RNA, 1413 nt, Artificial Sequence
  derived and/or modified CDS sequence (AUadapt) from InfluenzaA__BAF63116__NA
augaaccccaaccagaagaucaucaccaucggcucgaucuccaucgccaucgggaucaucagccugaugcuccaggugggcaacaucaucuccaucugggccucgcacuccauccagaccgggagccagaaccacacgggcaucugcaaccagcgcaucaucaccuacgagaacuccaccugggucaaccacaccuacgugaacaucaacaacacgaacguggucgcggggaaggacaagaccucgguggcccuggccggcaacuccagccugugcuccaucagcggcugggccaucuacaccaaggacaacuccauccggaucgggucgaagggcgacguguucgucauccgcgagccguucaucuccugcagccaccucgagugccggaccuucuuccugacgcagggggcccugcucaacgacaagcacuccaacggcaccgugaaggaccgcucgcccuaccgggcgcugauguccugcccccugggggaggcccccagcccguacaacucgaaguucgaguccguggccuggagcgccuccgcgugccacgacggccucggcuggcugaccaucgggaucagcggccccgacaacggggccgucgccgugcugaaguacaacggcaucaucaccgagacgaucaaguccuggaagaagcgcauccuccggacccaggagucggagugcgugugcgucaacggcuccugcuucaccaucaugaccgacgggcccagcaacggcgccgccuccuacaagaucuucaagaucgagaagggccaggugaccaagucgguggagcugaacgcgcccaacuuccacuacgaggagugcuccugcuacccggacacggggaccgucaugugcgugugccgcgacaacuggcacgggagcaaccggcccuggguguccuucaaccccgaccuggacuaccagaucggcuacaucugcucgggcgucuucggggacaacccccgcccgaaggacggcaagggguccugcaaccccgugaccguggacggcgccgacggggucaagggcuucagcuacaaguacggcaacgggguguggaucggccggacgaaguccaaccgccuccggaagggguucgagaugaucugggaccccaacggcuggaccgacaccgacagcgacuucuccgugaagcaggacgucguggccaucaccgacuggucgggguacagcggcuccuucguccagcaccccgagcugacgggccuggacugcauccgcccgugcuucuggguggagcucgugcgggggcugccccgcgagaacaccaccaucuggaccucgggcuccagcaucuccuucugcggggucgacagcgacacggccaacugguccuggcccgacggcgccgagcugcccuucaccaucgacaaguga

SEQ ID NO: 28549 - RNA, 1413 nt, Artificial Sequence
  derived and/or modified CDS sequence (AUadapt) from InfluenzaA__BAF63124__NA
augaaccccaaccagaagaucaucaccaucggcucgaucuccaucgccaucgggaucaucucgcugaugcuccagaucggcaacaucaucuccaucugggccagccacuccauccagaccgggucgcagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucucgggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgcgcgagcucaacgcccccaacuuccacuacgaggagugcuccugcuacccggacaccggcaccgugaugugcgugugccgggacaacuggcacgggagcaaccgccccugggucuccuucaaccccaaccuggacuaccagaucggcuacaucugcucgggcguggugggggacaacccccggccgaaggacggcaagggguccugcaaccccgucacggcggacggcgccgacggggugaagggcuucagcuacaaguacggcaacgggguguggaucggccgcaccaaguccaaccggcugcgcaagggguucgagaugaucugggaccccaacggcuggaccgacaccgacucggacuucuccgucaagcaggacgugguggccaucacggacuggagcggguacucgggcuccuucguccagcaccccgagcucaccggccuggacugcauccggccgugcuucuggguggagcugguccgcgggcucccccgggagaacaccaccaucuggacgagcggcuccucgaucuccuucugcgggguggacagcgacaccgccaacugguccuggcccgacggcgccgagcugcccuucaccaucgacaaguga

SEQ ID NO: 28550 - RNA, 1413 nt, Artificial Sequence; identical to SEQ ID NO: 23905
  derived and/or modified CDS sequence (AUadapt) from InfluenzaA__BAF63132__NA

SEQ ID NO: 28551 - RNA, 1413 nt, Artificial Sequence
  derived and/or modified CDS sequence (AUadapt) from InfluenzaA__BAF63136__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugcaagacguucuuccugacccagggggcccugcucaacgacaagcacuccaacggcaccgucaaggaccggucgcccuaccgcgcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcggacccaggagucggagugcgugugcaugaacggguccugcuucaccaucaugacggacggccccagcaacggggccgccuccuacaagaucuucaagaucgagaagggcaaggugaccaagucgaucgagcucaacgcccccaacuuccacuacgaggagugcuccugcuacccggacaccgggaccgucaugugcgugugccgcgacaacuggcacggcagcaaccggcccuggguguccuucaaccagaaccuggacuaccagaucggcuacaucugcucgggggucuucggcgacaacccccgccccaaggacggggagggcuccugcaacccggugacgguggacggggcgaacggcgucaagggcuucagcuacaaguacgggaacggcguguggaucgggcggaccaaguccaaccgccugcggaagggcuucgagaugaucugggaccccaacggguggaccaacaccgacagcgacuucuccgugaagcaggacgucguggccaucacggacuggucgggcuacagcggcuccuucgugcagcaccccgagcucaccgggcuggacugcauccgccccugcuucugggucgagcuggugcggggccucccgcgcgagaacaccaccaucuggacgucgggguccagcaucuccuucugcggcgucaacagcgacaccgccaacugguccuggcccgacggcgccgagcugcccuucaccaucgacaaguga

SEQ ID NO: 28552 - RNA, 1350 nt, Artificial Sequence
  derived and/or modified CDS sequence (AUadapt) from InfluenzaA__BAH24021__NA
augaaucccaaccaaaagaucaucaccaucggcagcaucugcauggugaucgggaucgucucccugaugcuccagaucggcaacauggugagccugugggugucccacaguauccagaccgggaaccagcaccaggucgagccgaucuccaacacgaacuuccugaccgagaaagccguggccagcgugacccucgcgggcaacuccagucugugccccauccgcgggugggccguccacuccaaggacaacagcauccggaucggcuccaagggcgacguguucgugauccgcgagcccuuuaucagcugcucccaccuggagugccggaccuucuuccucacgcagggggcccugcugaacgauaagcacagcaacggcaccgucaaggaccgcagcccccaccggacccucaugagcuguccggugggggaggcccccucccccuacaacagccgcuucgaauccguggccuggagcgcgagcgccugccaugacggcaccuccuggcugacgaucgggaucagcggccccgacaacggcgccgucgccgugcugaaguacaacgggaugaucaccgacaccaucaaguccuggcggaauaacauccuccgcacccaggagagcgagugcgcgugcgugaacggcuccugcuucacggucaugaccgaugggccgagcaacggccaggccuccuacaagaucuucaagauggaaaagggcaagguggugaaguccgucgagcuggacgcccccaacuaucacuacgaggagugcuccugcuaccccgacgccggggagaucacgugcgugugucgggacaacuggcacggcagcaaccgccccuggguguccuucaaccaaaaucuggaguaccagaucggguacaucugcagcggcgucuucggggacaacccgcggcccaauggcggcaccggguccugcggccccgugagccccaacggggccuacggcgugaagggguucuccuucaaguacggcaauggcgucuggaucgggcgcaccaagagcccguccagccgguccggcuucgagaugaucugggaccccaacggguggaccgagaccgacagcaguuucuccgugaagcaagacaucgucgcgaucaccgacuggagcggcuacuccgggagcuucgugcagcaucccgagcucacgggccuggacugcauccgccccugcuucuggguggagcugauccggggccgcccgaaggaguccaccaucuggaccagcggguccagcaucuccuucuguggcgucaacagcgacaccguguccuggagcuggcccgacggggccgagcuccccuucacgaucgacaaguga

SEQ ID NO: 28553 - RNA, 1410 nt, Artificial Sequence; identical to SEQ ID NO: 19295
  derived and/or modified CDS sequence (AUadapt) from InfluenzaA__BAH95825__NA

SEQ ID NO: 28554 - RNA, 1410 nt, Artificial Sequence; identical to SEQ ID NO: 16274
  derived and/or modified CDS sequence (AUadapt) from InfluenzaA__BAH95826__NA

SEQ ID NO: 28555 - RNA, 1410 nt, Artificial Sequence
  derived and/or modified CDS sequence (AUadapt) from InfluenzaA__BAJ07994__NA
augaaccccaaccagaagaucaccaccaucggcucgaucugcauggugaucgggaucgucucccugaugcuccagaucggcaacaucaucagcaucugggugucccacucgauccagacggggaaccagcaccaggccgagccgugcaaccaguccaucaucaccuacgagaacaacaccugggugaaccagaccuacgucaacaucagcaacacgaacuuccugaccgagaaggccguggcguccgugacccuggccggcaacagcucccucugccccaucucggggugggccgucuacuccaaggacaacggcauccgcaucggcagcaagggggacguguucgugauccgggagcccuucaucuccugcucgcaccuggagugccgcaucuucuuccugacccagggcgcccuccugaacgacaagcacuccaacgggacggucaaggaccggagcccccaccgcacccugauguccugcccggugggcgaggcccccagccccuacaacucccgguucgagucgguggcguggagcgccuccgccugccacgacgggaccucguggcucaccaucggcaucuccggccccgacaacggggccgucgcggugcugaaguacaacggcaucaucacggacaccaucaagagcuggcgcaacaacaucaugcggacccaggaguccgagugcgccugcgugaacgggagcugcuucaccgucaugacggacggcccguccaacggccaggccucguacaagaucuuccgcaucgagaaggggaagguggugaaguccgccgagcugaacgcccccaacuaccacuacgaggagugcagcugcuaccccgacgcgggcgagaucacgugcgucugccgggacaacuggcacggguccaaccgccccugggugucguucaaccagaaccucgaguaccggaucggcuacaucugcuccgggguguucggcgacaacccgcgccccaacgacggcaccgggagcugcggccccgucucccccaagggggccuacggcaucaagggguucagcuucaaguacggcaacggcguguggaucgggcggaccaaguccaccaacucgcgcuccggcuucgagaugaucugggacccgaacggguggaccggcaccgacagcaacuucucggugaagcaggacaucgucgccaucaccgacugguccggguacagcggcuccuucgugcagcaccccgagcugacgggccuggacugcauccggcccugcuucugggucgagcucauccgcgggcggcccaaggagagcaccaucuggaccuccggcucguccaucagcuucugcggggugaacuccgacaccgugggcuggagcuggccggacggcgccgagcugcccuucacgaucgacaaguga

SEQ ID NO: 28556 - RNA, 1350 nt, Artificial Sequence
  derived and/or modified CDS sequence (AUadapt) from InfluenzaA__BAK23415__NA
augaaucccaaccaaaagaucaucaccaucggcagcgugugcaugaucaucgggaucgucucccugaugcuccagaucggcaacaugaucagcaucuggguggggcacuccauccagaccggcaaucagugccacgccgagccgaucagcaacacgaaguuccccaccgagaaggccgcggccuccgugacccuggccgggaacagcucccugugucccaucagcggcugggccgucuacuccaaggacaacagcauccgcaucggcucccgcggggacguguuugugauccgggaacccuucaucagcugcucccaccucgagugccggaccuucuuccugacgcagggcgcccugcucaaugacaagcacagcaacgggaccgucaaggaccgcuccccgcaccggacccugaugaguugccccgugggcgaggcgcccucccccuacaacagccgcuucgaguccguggccuggagcgccagcgccugucacgacgggaccuccuggcugacgaucggcaucagcggcccggacaacggggcggucgccgugcucaaguacaauggcaucaucaccgacaccaucaaguccuggcggaacaacauccugcgcacccaggaaagcgagugcgccugcaucaacggguccuguuucacggugaugaccgacggccccagcuccggccaggccagcuacaagaucuucaagauggagaaggggaaggucgugaaguccguggagcuggaugcccccaacuaccacuacgaagagugcagcugcuaucccgacgcgggcgagaucacgugcgucugccgggacaacuggcacggguccaaucgcccgugggugagcuucaaccagaaccucgaguaccagaucggcuacaucugcuccgggguguuuggcgacaacccccggcccaacgacggcaccgggagcugcggccccgucuccccgaauggggccuacggcgugaagggguucagcuucaaguacggcaacggcguguggaucgggcgcaccaaguccaccaacagucgguccggcuucgagaugaucugggaccccaacggguggaccggcaccgacagcagcuuuuccgucaaacaggacaucguggccaucacggacuggagcggguacuccggcagcuucgugcagcaccccgagcugaccggccuggauugcauccgccccugcuucugggucgagcucauccgggggcgcccgaaggaguccaccaucuggaccagcggcuccagcaucuccuucuguggggugaacagcgacacggucuccuggagcuggcccgacggcgccgagcugcccuucaccaucgacaaguga

SEQ ID NO: 28557 - RNA, 1350 nt, Artificial Sequence
  derived and/or modified CDS sequence (AUadapt) from InfluenzaA__BAK23416__NA
augaaucccaaccaaaagaucaucaccaucggcagcaucugcauggugaucgggaucgucucccugaugcuccagaucggcaacaugaucagcaucugggugucccacagcauccagaccgggaaucagugccaggccgagccgaucuccaacacgaaguuccugaccgaaaaggccguggcgagcgucacccuggccggcaacuccagccucugccccaucuccgggugggccguguauagcaaggacaacuccauccgcaucggcagccggggcgacguguucgucauccgcgagcccuucaucuccugcagucaccuggagugccggaccuucuuccugacgcagggggcccuccugaacgacaagcacuccaauggcaccgugaaggaccgcagcccccaccggacccugauguccugcccggugggggaggcccccagccccuacaacucccgcuuugaaagcgucgcguggagcgccuccgccugccacgacggcaccagcuggcucacgaucgggaucuccggccccgacaacggcgccguggcggugcugaaguauaacgggaucaucaccgacaccaucaagagcuggcggaacaacauccugcgcacccaggaguccgagugcgccugcgucaauggcagcugcuucacggugaugaccgacgggccguccagcggccaggccuccuacaagaucuucaaaauggagaagggcaagguggucaagagcguggagcucgaugcccccaacuaccacuacgaggagugcuccugcuaccccgaugccggggagaucacgugcgugugccgggacaacuggcacggcagcaaccgccccugggucuccuuuaaccaaaaccuggaguaccagaucggguacaucugcagcggcguguucggggacaauccgcggcccaacgacggcaccggcuccugcgggcccgcgagccccaacggcgccuacggggugaagggcuucuccuuuaaguacgggaacggcgucuggaucggccgcaccaagagcaccaacucccggagcggguucgagaugaucugggacccgaauggcuggaccgggaccgacagcuccuucagcgugaagcaagacaucguggccaucacggacugguccggcuacagcggguccuuuguccagcaccccgagcugaccggccucgacugcauccgccccugcuucuggguggagcugauccggggccgccccaaggagagcaccaucuggaccuccgggagcuccaucaguuucugcggcgucaacuccgacacggugagcugguccuggccggacggggccgagcugcccuucaccaucgacaaguga

SEQ ID NO: 28558 - RNA, 1350 nt, Artificial Sequence
  derived and/or modified CDS sequence (AUadapt) from InfluenzaA__BAK23417__NA
augaaucccaaccaaaagaucaucaccaucggcagcaucugcauggugaucgggaucgucucccugaugcuccagaucggcaacaugaucagcaucugggugucccacagcauccagaccgggaaccagugucaguccgagccgaucagcaacacgaaguuccugaccgaaaaggccguggccuccgucacccuggcgggcaacagcucccucugccccaucagcgggugggccguguacuccaaggacaauagcauccgcaucggcucccggggcgacguguucgucauccgcgagcccuucaucagcugcucccaccuggagugccggaccuuuuuccugacgcagggggcccuccugaacgacaagcacagcaacggcaccgugaaggaccgcagcccccaccggacccugauguccuguccggugggggaggcccccucccccuacaacagccgcuucgaaagcgucgccugguccgcgagcgccugccacgauggcaucuccuggcucaccaucgggaucagcggccccgacaacggcgccguggccgugcugaaguacaacgggaucaucacggacaccaucaaguccuggcggaacaacauccugcgcacccaggagagcgagugugcgugcgucaacggcuccugcuucaccgugaugacggacgggccgagcuccggccaggccagcuacaagaucuucaaaauggagaagggcaagguggucaaguccguggagcucgaugcccccaacuaccacuacgaggagugcagcugcuaccccgaugccggggagaucacgugcgugugccgggacaacuggcacggcuccaaccgccccugggucagcuucaaccaaaaucuggaguaccagaucggguacaucugcuccggcguguucggggacaacccgcggcccaacgacggcaccggcaguugcgggcccgugucccccaacggcgccuacggggucaagggcuucagcuucaaguacgggaacggcguguggaucggccgcaccaaguccaccaacagucggagcggguucgagaugaucugggacccgaacggcuggaccgggaccgacuccagcuucuccgugaagcaagacaucgucgcgaucaccgauuggagcggcuacuccgggagcuucgugcagcaccccgagcugacgggccucgacugcauccgccccugcuucugggucgagcugauccggggccgccccaaggaguccaccaucuggaccaguggguccagcaucuccuucugcggcgugaacggggacaccgugagcugguccuggccggacggcgccgagcugcccuucacgaucgacaaguga

SEQ ID NO: 28559 - RNA, 1350 nt, Artificial Sequence
  derived and/or modified CDS sequence (AUadapt) from InfluenzaA__BAK23418__NA
augaaucccaaccaaaccaucaucaccaucggcagcaucugcauggugaucgggaucgucucccugaugcuccagaucggcaacaugaucagcaucugggugucccacagcauccagacggggaaucagugccaggccgagccgaucuccaacaccaaguuccugaccgaaaaggccguggcgagcgucacccuggccggcaacuccagccucugccccaucuccgggugggccguguacaguaaggacaacuccauccgcaucggcagccggggcgacguguucgucauccgcgagcccuucaucuccugcagccaucuggagugccggacguucuuccugacccagggggcccuccugaacgacaagcacuccaacggcaccgugaaagaccgcaguccccaccggacccugauguccugcccggugggggaggcccccagccccuacaacucccgcuucgagagcgucgcguggagcgccuccgccugucacgacggcacgagcuggcucaccaucgggaucuccggccccgacaacggcgccguggcggugcugaaguacaacgggaucaucaccgacaccaucaagaguuggcggaacaacauccugcgcacgcaggaguccgaaugcgccugcgucaacggcagcugcuucaccgugaugaccgaugggccguccagcggccaggccuccuacaagaucuucaagauggagaagggcaagguggucaaaagcguggagcucgacgcccccaacuaccacuaugaggagugcuccugcuaccccgacgccggggagaucacgugcgugugccgggacaacuggcauggcagcaaccgccccugggucuccuucaaccagaaccuggaguaccaaaucggguacaucugcaguggcguguucggggacaacccgcggcccaacgacggcaccggcuccugcgggcccgugagccccaacggcgcguauggggucaagggcuucuccuucaaguacgggaacggcguguggaucggccgcaccaagagcaccaacucccggagcggguucgagaugaucugggauccgaacggcuggaccgggacggacagcuccuucagcgugaagcaggacaucgucgccaucaccgacugguccggcuacaguggguccuucgugcaacaccccgagcugaccggccucgacugcauccgccccugcuucugggucgagcugauccggggccgccccaaggagagcaccaucuggacguccgggagcuccaucaguuucugcggcgugaacuccgacaccgugagcugguccuggccggacggggccgagcugcccuucaccaucgacaaguga

SEQ ID NO: 28560 - RNA, 1350 nt, Artificial Sequence; identical to SEQ ID NO: 18979
  derived and/or modified CDS sequence (AUadapt) from InfluenzaA__BAK23420__NA

SEQ ID NO: 28561 - RNA, 1350 nt, Artificial Sequence; identical to SEQ ID NO: 18979
  derived and/or modified CDS sequence (AUadapt) from InfluenzaA__BAK23421__NA

SEQ ID NO: 28562 - RNA, 1350 nt, Artificial Sequence
  derived and/or modified CDS sequence (AUadapt) from InfluenzaA__BAK23422__NA
augaaucccaaccaaaagaucaucaccaucggcagcgugugcauggucaucgggaucgugucccugaugcuccagaucggcaacaugaucagcaucuggguggggcacuccauccagaccggcaaucagugccacgccgagccgaucagcaacacgaaguuccccaccgaaaaggccgcggccuccgucacccuggccgggaacagcucccugugucccaucagcggcugggccguguacuccaaggacaacagcauccgcaucggcucccgcggggacguguuugucauccgggagcccuucaucagcugcucccaccucgagugccggaccuucuuccugacgcagggcgcccugcucaaugacaagcacagcaacgggaccgugaaagaccgcuccccgcaccggacccugaugaguugccccgugggcgaggcgcccucccccuacaacagccgcuucgaguccgucgccuggagcgccagcgccugucacgacgggaccuccuggcugacgaucggcaucagcggcccggacaacggggcgguggccgugcucaaguacaauggcaucaucaccgacaccaucaaguccuggcggaacaacauccugcgcacccaggagagcgaaugcgccugcgucaacggguccuguuucacggugaugaccgacggccccagcuccggccaggccagcuacaagaucuucaagauggagaaggggaagguggucaaauccguggagcuggaugcccccaacuaccacuacgaggagugcagcugcuaucccgacgcgggcgagaucacgugcgugugccgggacaacuggcacggguccaaucgcccgugggucagcuucaaccagaaccucgaguaccaaaucggcuacaucugcuccgggguguuuggcgacaacccccggcccaacgacggcaccgggagcugcggccccguguccccgaauggggccuacggcgucaagggguucagcuucaaguacggcaacggcguguggaucgggcgcaccaaguccaccaacagucgguccggcuucgagaugaucugggaccccaacggguggaccggcaccgacagcagcuuuuccgugaagcaggacaucgucgccaucacggacuggagcggguacuccggcagcuucgugcaacaccccgagcugaccggccuggauugcauccgccccugcuucugggucgagcucauccgggggcgcccgaaggaguccaccaucuggaccagcggcuccagcaucuccuucuguggggugaacagcgacacgguguccuggagcuggcccgacggcgccgagcugcccuucaccaucgacaaguga

SEQ ID NO: 28563 - RNA, 1350 nt, Artificial Sequence
  derived and/or modified CDS sequence (AUadapt) from InfluenzaA__BAK23423__NA
augaaucccaaccaaaagaucaucaccaucggcagcaucugcauggugaucgggaucgucucccugaugcuccagaucggcaacaugaucagcaucugggugucccacagcauccagaccgggaaucagugccaggccgagccgaucuccacgaccaaauuccugaccgagaaggccguggcgagcgucacccuggccggcaacuccagccucugccccaucuccgggugggccguguacagcaaggauaacuccauccgcaucggcccccggggcgacguguucgucauccgcgagcccuucaucagcugcucccaccuggagugccggacguuuuuccugacccagggggcccuccugaacgacaaacacagcaacggcaccgugaaggaccgcuccccgcaccggacccugaugaguugccccgugggggaggcccccucccccuacaacagccgcuucgaguccgucgcguggagcgccagcgccugccaugacggcaucuccuggcucacgaucgggaucagcggcccggacaacggcgccguggcggugcugaaguacaacgggaucaucaccgacaccaucaaguccuggcggaacaauauccugcgcacccaggaaagcgagugcgccugcgucaacggcuccugcuucacggugaugaccgacgggcccagcuccggccaggccaguuacaagaucuucaagauggagaagggcaagguggucaaauccguggagcucgacgcccccaacuaccacuacgaggaguguagcugcuaccccgacgccggggagaucacgugcgugugccgggacaacuggcauggcuccaaccgcccgugggucagcuucaaccagaaccuggaguaccaaaucggguacaucugcuccggcguguuuggggacaacccccggcccaacgacggcaccggcagcugcgggcccguguccccgaacggcgcguacggggucaagggcuuuagcuucaaguacgggaacggcguguggaucggccgcaccaaguccaccaacagccgguccggguucgagaugaucugggaccccaauggcuggaccgggaccgacagcagcuucuccgugaagcaggacaucgucgccaucacggacuggagcggcuacuccgggaguuucgugcaacaccccgagcugaccggccucgacugcauccgccccugcuucugggucgagcugauccggggccgcccgaaggaguccaccaucuggaccagcggguccagcaucuccuuuugcggcgugaacagcgacacgguguccuggagcuggcccgacggggccgagcugcccuucaccaucgacaaguga

SEQ ID NO: 28564 - RNA, 1350 nt, Artificial Sequence
  derived and/or modified CDS sequence (AUadapt) from InfluenzaA__BAK23424__NA
augaaucccaaccaaaagaucaucaccaucggcagcaucugcauggugaucgggaucgucucccugaugcuccagaucggcaacaugaucagcaucugggugucccacagcauccagaccgggaaccagugucagggcgagccgaucuccaacacgaaguuccugaccgaaaaggccguggccagcgucacccuggcggggaacuccagccucugccccaucuccggcugggccguguacagcaaggacaauuccauccgcaucggcagccgcggggacguguucgucauccgggagcccuucaucuccugcagccaccuggagugccggaccuuuuuccugacgcagggcgcccuccugaacgacaagcacuccaacgggaccgugaaggaccgcagcccccaccggacccugauguccugcccggugggcgaggcccccagucccuacaacucccgcuucgaaagcgucgccuggagcgcguccgccugccacgacgggaccagcuggcucacgaucggcaucuccggccccgauaacggggccguggccgugcugaaguacaacggcaucaucaccgacaccaucaagagcuggcggaacaacauccugcgcacccaggaguccgagugcgcgugugucaacgggagcugcuucacggugaugaccgacggcccguccagcggccaggccuccuacaagaucuucaaaauggagaaggggaagguggucaagagcguggagcucgaugcccccaacuaccacuacgaggagugcuccugcuaccccgacgccggcgagaucacgugcgugugucgggacaacuggcacgggagcaaccgccccugggucuccuucaaccaaaaccuggaguaucagaucggcuacaucugcagcgggguguucggcgacaacccgcggcccaacgacggcaccggguccugcggccccguguuuagcaacggggccuacggcgucaagggguucuccuucaaguacggcaacggcguguggaucgggcgcaccaagagcaccaacucccggaguggcuucgagaugaucugggaccccaacggguggaccggcaccgacagcuccuucagcgggaagcaagacaucguggcgaucacggauugguccggcuacagcggcuccuucguccagcacccggagcugaccgggcucgacugcauccgccccugcuucuggguggagcugauccggggccgccccaaggagagcaccaucuggaccuccgggaguuccaucagcuucugcggcgucaacuccgacacggugagcugguccuggcccgacggcgccgagcugccguucaccaucgacaaguga

SEQ ID NO: 28565 - RNA, 1350 nt, Artificial Sequence
  derived and/or modified CDS sequence (AUadapt) from InfluenzaA__BAK23425__NA
augaaucccaaccaaaagaucaucaccaucggcagcaucugcauggugaucgggaucgucucccugaugcuccagaucggcaacaugaucagcaucugggugucccacagcauccagaccgggaaccagugccaggccgagccgaucuccaauacgaaguuccugaccgaaaaggccguggcgagcgucacccuggccggcaacuccagccucugccccaucuccgggugggccguguacagcaaggacaacuccauccgcaucggcagucggggcgacguguucgucauccgcgagcccuucaucuccugcagccaccuggagugccggaccuucuuccugacgcagggggcccuccugaaugacaagcacuccaacggcaccgugaaggaccgcagcccccaccggacccugauguccugcccggugggggaggcccccagccccuacaacucccgcuuugaaagcgucgcguggagcgccuccgccugccacgacggcaucagcuggcucaccaucgggaucuccggccccgacaacggcgccguggcggugcugaaguacaaugggaucaucacggacaccaucaagagcuggcggaacaacauccugcgcacccaggaguccgagugcgccugcgucaacggcagcugcuuuaccgugaugacggacgggccguccagcggccaggccuccuacaagaucuucaaaauggagaagggcaagguggucaagagcguggagcucgacgcccccaacuaccacuacgaggaguguuccugcuaccccgacgccggggagaucacgugcgugugccgggacaacuggcacggcagcaaucgccccugggucuccuucaaccaaaaccuggaguaccagaucggguacaucugcagcggcguguucggggacaauccgcggcccaacgacggcaccggcuccugcgggcccgugagccccaacggcgcguacggggucaagggcuucuccuucaaguacgggaacggcguguggaucggccgcaccaagaguaccaacucccggagcggguucgagaugaucugggacccgaacggcuggaucgggaccgacagcuccuucagcgugaagcaagauaucgucgccaucaccgacugguccggcuacagcggguccuucgugcagcaccccgagcugaccggccucgacugcauccgccccugcuucugggucgagcugauccggggccgccccaaggagaguacgaucuggaccuccgggagcuccaucagcuucugcggcgugaacuccgacaccgugagcugguccuggccggacggggccgagcugcccuucaccaucgacaaguga

SEQ ID NO: 28566 - RNA, 1350 nt, Artificial Sequence
  derived and/or modified CDS sequence (AUadapt) from InfluenzaA__BAK23426__NA
augaaucccaaccaaaagaucaucaccaucggcagcaucugcauggugaucgggaucgucucccugaugcuccagaucggcaacaugaucagcaucugggugucccacagcauccagaccgggaaccagugucaggccgagccgaucuccaacacgaaguucuucaccgagaaggccguggcgagcgucacccuggccggcaacuccagccugugccccaucuccgggugggccguguacagcaaagauaacuccauccgcaucggcagccggggcgacguguucaucauccgcgagcccuucaucuccugcagccaccucgagugucggaccuucuuccugacgcagggggcccugcucaacgacaagcacuccaacggcaccgucaaggaccgcagcccccaccggacccugauguccuguccggugggggaggcccccagccccuacaacucccgcuucgagagcguggcguggagcgccuccgccugccacgacggcaccaguuggcugacgaucgggaucuccggccccgacaacggcgccgucgcggugcucaaguacaacgggaucaucaccgacaccaucaagagcuggcggaacaacauccugcgcacccaagaguccgagugugccugcgugaacggcagcugcuucacggucaugaccgacgggccguccagcggccaggccuccuacaagaucuucaagauggagaagggcaagguggucaagaguguggaacuggacgcccccaacuaccacuacgaggagugcuccugcuaccccgacgccggggagaucacgugugugugccgggacaacuggcacggcagcaaccgccccuggguguccuucaaccagaaucucgaguaccagaucggguacaucugcagcggcgucuucggggacaacccgcggcccaacgacggcaccggcuccugugggcccgugagccccaacggcgcguacggggugaagggcuucuccuucaaguacgggaacggcgucuggaucggccgcaccaagagcaccaacucccggaguggguucgaaaugaucugggacccgaacggcuggaccgggaccgacagcuccuucagcgugaagcaggacaucguggccaucacggauugguccggcuacagcggguccuucguccagcaccccgagcugaccggccuggacugcauccgccccugcuucuggguggagcucauccggggccgccccaaggagagcaccaucuggaccuccgggaguuccaucagcuucugcggcgucaacuccgacacggugagcugguccuggccggacggggccgagcugcccuucaccaucgacaaguga

SEQ ID NO: 28567 - RNA, 1350 nt, Artificial Sequence; identical to SEQ ID NO: 28565
  derived and/or modified CDS sequence (AUadapt) from InfluenzaA__BAK23427__NA

SEQ ID NO: 28568 - RNA, 1350 nt, Artificial Sequence
  derived and/or modified CDS sequence (AUadapt) from InfluenzaA__BAK23428__NA
augaaucccaaccaaaagaucaucaccaucggcagcaucugcauggugaucgggaucgucucccugaugcuccagaucggcaacaugaucagcaucugggugucccacaguauccagaccgggaaccagugccaggccgagccgaucuccaacacgaaguuccugaccgaaaaggccguggcgagcgucacccuggccggcaacuccagccucugucccaucuccgggugggccguguacagcaaggacaacuccauccgcaucggcagccggggcgacguguucgucauccgcgagcccuuuaucuccugcagccaccuggagugccggaccuucuuccugacgcagggggcccuccugaacgauaagcacuccaacggcaccgugaaggaccgcagcccccaccggacccugauguccugcccggugggggaggcccccagccccuauaacucccgcuucgaaagcgucgcguggagcgccuccgccugccacgauggcaccagcuggcucacgaucgggaucuccggccccgacaacggcgccguggcggugcugaaguacaacgggaucaucaccgacaccaucaagagcuggcggaauaacauccugcgcacccaggaguccgagugcgccugcgucaacggcagcugcuucacggugaugaccgaugggccguccagcggccaggccuccuacaagaucuucaaaauggagaagggcaagguggucaagagcguggagcucgacgcccccaacuaccauuacgaggagugcuccugcuaccccgacgccggggagaucacgugcgugugccgggauaacuggcacggcagcaaccgccccugggucuccuucaaccaaaaccuggaguaucagaucggguacaucugcagcggcguguucggggacaacccgcggcccaaugacggcaccggcuccugcgggcccgugagccccaacggcgcguacggggucaagggcuucuccuucaaguaugggaacggcguguggaucggccgcaccaagagcaccaacucccggagcggguucgagaugaucugggacccgaacggcuggaccgggaccgauagcuccgugagcgucaagcaagacaucguggccaucacggacugguccggcuacagcggguccuucguccagcaucccgagcugaccggccucgacugcauccgccccugcuuccggguggagcugauccgcggccggcccaaggagagcaccaucuggaccuccgggagcuccaucagcuuuugcggcgugaacuccgacacggucagcugguccuggccggacggggccgagcugcccuucaccaucgacaaguga

SEQ ID NO: 28569 - RNA, 1350 nt, Artificial Sequence; identical to SEQ ID NO: 28565
  derived and/or modified CDS sequence (AUadapt) from InfluenzaA__BAK23429__NA

SEQ ID NO: 28570 - RNA, 1350 nt, Artificial Sequence
  derived and/or modified CDS sequence (AUadapt) from InfluenzaA__BAK23430__NA
augaaucccaaccaaaagaucaucaccaucggcagcaucugcauggugaucgggaucgucucccugaugcuccagaucggcaacaugaucagcaucugggugucccacagcauccagaccgggaaccagugccaggccgagccgaucuccaauacgaaguuccugaccgaaaaggccguggcgagcgucacccuggccggcaacuccagccucugccccaucuccgggugggccguguacagcaaggacaacuccauccgcaucggcagucggggcgacguguucgucauccgcgagcccuucaucuccugcagccaccuggagugccggaccuucuuccugacgcagggggcccuccugaaugacaagcacuccaacggcaccgugaaggaccgcagcccccaccggacccugauguccugcccggugggggaggcccccagccccuacaacucccgcuuugaaagcgucgcguggagcgccuccgccugccacgacggcaucagcuggcucaccaucgggaucuccggccccgacaacggcgccguggcggugcugaaguacaaugggaucaucacggacaccaucaagagcuggcggaacaacauccugcgcacccaggaguccgagugcgccugcgucaacggcagcugcuuuaccgugaugacggacgggccguccagcggccaggccuccuacaagaucuucaaaauggagaagggcaagguggucaagagcguggagcucgacgcccccaacuaccacuacgaggaguguuccugcuaccccgacgccggggagaucacgugcgugugccgggacaacuggcacggcagcaaucgccccugggucuccuucaaccaaaaccuggaguaccagaucggguacaucugcagcggcguguucggggacaauccgcggcccaacgacggcaccggcuccugcgggcccgugagccccaacggcgcguacggggucaagggcuucuccuucaaguacgggaacggcguguggaucggccgcaccaagaguaccaacucccggagcggguucgagaugaucugggacccgaacggcuggaucgggaccgacagcuccuucagcgugaagcaagauaucgucgccaucaccgacugguccggcuacagcggguccuucgugcagcaccccgagcugaccggccucgacugcaugcgccccugcuucugggucgagcugauccggggccgccccaaggagaguacgaucuggaccuccgggagcuccaucagcuucugcggcgugaacuccgacaccgugagcugguccuggccggacggggccgagcugcccuucaccaucgacaaguga

SEQ ID NO: 28571 - RNA, 1350 nt, Artificial Sequence
  derived and/or modified CDS sequence (AUadapt) from InfluenzaA__BAK23431__NA
augaaucccaaccaaaagaucaucaccaucggcagcaucugcauggugaucgggaucgucucccugaugcuccagaucggcaacaugaucagcaucugggugucccacagcauccagaccgggaaucagugccaggccgagccgaucuccaacacgaaauuccugaccgagaaggccguggcgagcgucacccuggccggcaacuccagccucugccccaucuccgggugggccguguacaguaaggacaacuccauccgcaucggcagccggggcgacguguucgucauccgcgagcccuucaucuccugcagccaucuggagugccggaccuucuuccugacgcagggggcccuccugaacgacaaacacuccaacggcaccgugaaggaccgcaguccccaccggacccugauguccugcccggugggggaggcccccagccccuacaacucccgcuucgagagcgucgcguggagcgccuccgccugucacgacggcaccagcuggcucacgaucgggaucuccggccccgacaacggcgccguggcggugcugaaguacaacgggaucaucaccgacaccaucaagaguuggcggaacaacauccugcgcacccaggaauccgagugcgccugcgucaacggcagcugcuucacggugaugaccgaugggccguccagcggccaggccuccuacaagaucuucaagauggagaagggcaagguggucaaaagcguggagcucgacgcccccaacuaccauuacgaggagugcuccugcuaccccgacgccggggagaucacgugcgugugccgggacaauuggcacggcagcaaccgccccugggucuccuucaaccagaaccuggaguaccaaaucggguacaucuguagcggcguguucggggacaacccgcggcccaacgacggcaccggcuccugcgggcccgugagccccaauggcgcguacggggucaagggcuucuccuucaaguacgggaacggcguguggaucggccgcaccaagagcaccaacucccggagcggguuugagaugaucuggggcccgaacggguggaccggcaccgacagcuccuucagcgugaagcaggacaucgucgccaucacggacugguccggguacaguggcuccuucgugcaacaccccgagcugaccggccucgacugcauccgccccugcuucugggucgagcugauccgggggcgccccaaggagagcaccaucuggaccuccggcagcuccaucaguuucugcggggugaacuccgacacggugagcugguccuggccggacggcgccgagcugcccuucaccaucgacaaguga

SEQ ID NO: 28572 - RNA, 1350 nt, Artificial Sequence; identical to SEQ ID NO: 28565
  derived and/or modified CDS sequence (AUadapt) from InfluenzaA__BAK23432__NA

SEQ ID NO: 28573 - RNA, 1350 nt, Artificial Sequence; identical to SEQ ID NO: 28565
  derived and/or modified CDS sequence (AUadapt) from InfluenzaA__BAK23433__NA

SEQ ID NO: 28574 - RNA, 1410 nt, Artificial Sequence
  derived and/or modified CDS sequence (AUadapt) from InfluenzaA__BAM65748__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugagcugcgaccccgacaagugcuuccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggucguccagcuccugccacgacgggaaggccuggcuccacgugugcgugaccggcgacgacaagaacgcgaccgccagcuucaucuacaacgggcgccugguggacuccaucgucucgugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucucguccuacgugugcagcggccuggugggcgacacgccccgcaagaccgacuccagcuccucgucccacugccucgaccccaacaacgaggagggcgggcacggggucaagggcugggccuucgacgacgggaacgacguguggaugggccggaccaucagcgagaagucccgccugggcuacgagaccuucaaggucaucgggggcuggagcaaccccaacuccaagucgcagaucaaccgccaggugaucguggacauggggaaccgguccggcuacagcgggaucuucagcgucgagggcaaguccugcaucaaccggugcuucuacguggagcugauccgcggccggaaggacgagaccgaggugcucuggaccucgaacuccaucgucguguucugcgggacgagcggcaccuacgggaccggcuccuggccggacggggccgacaucaagcugaugagcaucuga

SEQ ID NO: 28575 - RNA, 1350 nt, Artificial Sequence; identical to SEQ ID NO: 16291
  derived and/or modified CDS sequence (AUadapt) from InfluenzaA__BAM85817__NA

SEQ ID NO: 28576 - RNA, 1350 nt, Artificial Sequence
  derived and/or modified CDS sequence (AUadapt) from InfluenzaA__BAM85818__NA
augaaucccaaccagaagaucaucaccaucggcucgaucugcauggugaucgggaucgucucccugaugcuccagaucggcaacaugaucagcaucugggugucccacagcauccagaccgggaaucagcaccaggccgagccgauccgcaacacgaacuuccugaccgagaacgccguggcguccgucacccuggccggcaacagcucccucugucccauccgggggugggccgugcacagcaaggacaacuccauccgcaucggcagcaagggcgacguguucgucauccgggagcccuuuaucuccugcagccaccuggagugccgcaccuucuuccugacgcagggggcccuccugaacgauaagcacuccaacggcaccgugaaggaccggagcccccaccgcacccugauguccugcccggugggggaggcccccagccccuauaacucccgguucgagagcgucgcgugguccgccagcgccugccacgacggcaccaguuggcucacgaucgggaucuccggccccgacaacggcgccguggcggugcugaaguacaacgggaucaucaccgacaccaucaagagcuggcgcaacaauauccugcggacccaggaguccgagugcgccugcgucaacggcagcugcuucacggugaugaccgacgggccguccaauggccaggccagcuacaagaucuucaagauggagaagggcaagguggucaaguccguggagcucaacgcccccaacuaccacuaugaggagugcagcugcuaccccgacgccggggagaucaucugcgugugccgcgauaacuggcacggcuccaaccggcccugggucagcuucaaccagaaccuggaguaucagaucggguacaucugcuccggcguguucggggacaacccgcgccccaacgacggcaccggcaguugcgggcccgugucccccaacggcgcguacgggaucaagggcuucagcuucaaguacgggaauggcgucuggaucggccggaccaaguccacgaacagccgcuccggguucgagaugaucugggacccgaacggcuggaccgggaccgacagcaauuucuccgugaagcaggacaucguggccaucaccgacuggagcggcuacagcggguccuucguccagcaucccgagcugacgggccucgacugcauccggcccugcuucuggguggagcugauccgcggccggcccaaggagagcaccaucuggaccuccgggagcuccaucagcuuuugcggcgucaacuccgacaccgugagcugguccuggccggacggggccgagcugcccuucacgaucgacaaguga

SEQ ID NO: 28577 - RNA, 1350 nt, Artificial Sequence
  derived and/or modified CDS sequence (AUadapt) from InfluenzaA__BAM85819__NA
augaaucccaaccagaagaucaucaccaucggcagcaucugcauggugaucgggaucgucucccugaugcuccagaucggcaacaugaucagcaucugggugucccacagcauccagaccgggaaucagaaccagguggagccgaucaucaacacgaacuuccugaccgagaaggccgucgccuccaucacccuggcgggcaacagcucccucugccccauccgcgggugggccauccacaguaaggacaacuccauccggaucggcagcaagggcgacguguucgugauccgcgagcccuucaucuccugcagucaccuggagugccggaccuucuuccugacgcagggggcccuccugaacgacaagcacuccaacggcaccgucaaggaucgcagcccccaccggacccugauguccugcccggugggggaggcccccagccccuacaacucccgcuucgagaguguggccugguccgcgagcgccugccacgacggcaccagcuggcucacgaucgggaucuccggccccgacaacggcgccgucgccgugcugaaguacaaugggaucaucaccgacaccaucaagagcuggcggaacaacauccugcgcacccaggaguccgagugcgcgugcgugaacggcaguugcuucacggucaugaccgacgggccguccgacggccaggccagcuacaagaucuucaagauggagaagggcaaggugaucaaguccguggagcucgacgcccccaauuaccacuacgaggagugcagcugcuaccccgaugccggggagaucacgugcgucugccgggacaacuggcacggcuccaaccgccccugggugagcuucaaucagaaccuggaguaccagaucggguacaucugcuccggcguguucggggacaacccgcggcccaaugacggcaccggcagcugcgggcccgucucccacaacggcgccuacggggugaagggcuucagcuuuaaguacgggaacggcguguggaucggccgcaccaagucccccaacagccgguccggguucgagaugaucugggacccgaacggcuggagugagaccgacuccagcuucagcgucaagcaggacaucguggcgaucaccgacugguccggguacagcggcuccuuugugcagcaccccgagcugaccgggcucgacugcauccgccccugcuucugggucgagcugauccggggccgccccaaggagagcacgguguggaccuccggcagcuccaucaguuucugcggggucuccagcgacaccguguccuggagcuggccggacggcgccgagcugcccuucaccaucgacaaguga

SEQ ID NO: 28578 - RNA, 1350 nt, Artificial Sequence
  derived and/or modified CDS sequence (AUadapt) from InfluenzaA__BAM85820__NA
augaaucccaaccaaaagaucaucaccaucggcagcaucugcauggugaucgggaucgucucccugaugcuccagaucggcaacaugaucagcaucugggugucccacaguauccagaccgggaaccagcaccaggccgagccgaucuccaacacgaacuuccugaccgagaaggccguggcgagcgucacccuggccggcaacuccagucucugccccauccgcgggugggccgugcacuccaaggacaacagcauccggaucggcuccaagggcgacguguuugucauccgcgagcccuucaucagcugcucccaccuggagugccggaccuucuuccugacgcagggggcccuccugaaugacaagcacagcaacggcaccgugaaggaccgcagcccccaucggacccugauguccugcccggugggggaggcccccucccccuacaacagccgcuucgaguccgucgcguggagcgccagcgccugucacgacggcaccuccuggcucacgaucgggaucagcggccccgacaacggcgccguggcggugcugaaguacaaugggaucaucaccgacaccaucaaguccuggcggaacaacauccugcgcacccaggagagcgagugcgccugcgucaacggcuccuguuucacggugaugaccgacgggccgagcaacggccaggccuccuacaagaucuucaaaauggagaagggcaagguggucaagaguguggagcucgacgcccccaacuaccacuacgaggagugcuccugcuaucccgacgccggggagaucacgugcgugugccgggacaacuggcacggcaguaaccgccccugggucuccuucaaccagaaccuggaguaccagaucggguacaucugcaguggcguguucggggacaacccgcggcccaacgacggcaccggcuccugcgggcccgugagucccaacggcgcguacggggucaagggcuucuccuucaaguacgggaacggcguguggaucggccgcaccaagagcaccaauucccggagcggguucgagaugaucugggacccgaacggcuggaccgggaccgacuccagcuuuagcgugaagcaggacaucgucgccaucacggacugguccggcuacagcggguccuucgugcagcaccccgagcugaccggccucgauugcauccgccccugcuucugggucgagcugauccggggccgccccaaggagagcaccaucuggaccuccgggagcuccaucagcuuuugcggcgugaacuccgacacggugagcugguccuggccggacggggccgagcugcccuucaccaucgacaaguga

SEQ ID NO: 28579 - RNA, 1350 nt, Artificial Sequence; identical to SEQ ID NO: 17410
  derived and/or modified CDS sequence (AUadapt) from InfluenzaA__BAM85821__NA

SEQ ID NO: 28580 - RNA, 1350 nt, Artificial Sequence
  derived and/or modified CDS sequence (AUadapt) from InfluenzaA__BAM85822__NA
augaaucccaaccagaagaucaucaccaucggcucgaucugcauggugaccgggaucgucucccugaugcuccagaucggcaacaugaucagcaucugggugucccacagcauccacacggggaaucagcaccaguccgagccgaucagcaacaccaacuuccugaccgagaaggccguggccuccgucaagcuggcgggcaacagcucccucugccccaucaaugggugggccguguacagcaaggacaacuccauccgcaucggcagcaagggcgacguguucgucauccgggagcccuucaucuccuguagccaccuggagugccgcaccuucuuccugacgcagggggcccuccugaacgacaagcacuccaauggcaccgugaaggaccggagcccccaccgcacccugauguccugcccggugggggaggcccccucgcccuacaacucccgguucgagagcgucgccuggagugcguccgccugccacgacggcaccagcuggcucacgaucgggaucuccggccccgacaacggcgccguggccguggucaaguacaacgggaucaucaccgauaccaucaagagcuggcgcaacaacauccugcggacccaggaguccgagugcgcgugcgugaacggcagcugcuuuacggugaugaccgacgggccguccaacagccaggccucccacaagaucuucaagauggagaagggcaaggucgucaagagcguggagcuggacgcccccaacuaucacuacgaggagugcuccugcuaccccgacgccggcgagaucacgugcgugugccgcgauaacuggcacgggagcaaccggcccuggguguccuucaaccagaaccucgaguaccagaucggcuacaucuguagcgggguguucggcgacaacccgcgccccaacgacgggaccggcuccugcggccccgucucguccaauggggccuacggcgugaagggguucagcuucaaguacggcaacgggguguggaucggccggaccaaguccaccaacagccgcaguggcuucgagaugaucugggaccccaacggguggaccgagaccgacuccagcuucuccgucaagcaggacaucguggcgaucacggacuggaguggcuacuccgggagcuucguccagcacccggagcugaccggccuggacugcauccggcccugcuucuggguggagcucauccgcgggcggcccaaggaguccaccaucuggaccaguggcuccagcaucuccuucugcggcgugaacagcgacacggucgggugguccuggcccgacggcgccgagcugccguucaccaucgacaaguga

SEQ ID NO: 28581 - RNA, 1410 nt, Artificial Sequence
  derived and/or modified CDS sequence (AUadapt) from InfluenzaA__BAM85823__NA
augaaccccaaccagaagaucaccaccaucggcucgaucugcauggugaucgggaucgucucccugaugcuccagaucggcaacaucaucagcaucugggugucccacucgauccagacggggaaccagcaccaggccggcccgugcaaccaguccaucaucaccuacgagaacaacaccugggugaaccagaccuacgucaacaucagcaacacgaacuuccugaccgagaagaccguggccuccgugacccuggcggggaacagcucccucugccccaucucgggcugggccgucuacuccaaggacaacggcauccgcaucgggagcaagggcgacguguucgugauccgggagcccuucaucuccugcagccaccuggagugccgcacguucuuccugacccagggggcccuccugaacgacaagcacuccaacggcaccgucaaggaccggucgccccaccgcacccugauguccugcccggugggggaggcccccagccccuacaacucccgguucgagucgguggccuggagcgcguccgccugccacgacggcaucaacuggcucacgaucggcaucagcgggcccgacaacggcgccgucgccgugcugaaguacaacgggaucaucaccgacaccaucaaguccuggcgcaacaacauccugcggacccaggagucggagugcgcgugcgugaacggcuccugcuucacgaucaugaccgacggcccgagcaacgggcaggccuccuacaagaucuuccgcaucgagaagggcaaggucgucaagagcguggagcucaacgcccccaacuaccacuacgaggagugcuccugcuaccccgacgccggggagaucacgugcgugugccgggacaacuggcacggcucgaaccgccccuggguguccuucaaccagaaccuggaguaccagaucggguacaucugcagcggcaucuucggcgacaacccgcggcccaacgacgggaccggcuccugcgggcccgugucgcccaacggcgccuacgggaucaagggcuucuccuucaaguacggcaacggggucuggaucggccgcaccaagagcaccaacucccggagcggguucgagaugaucugggacccgaacggcuggaccgggaccgacuccaacuucucggugaagcaggacaucguggcgaucacggacuggagcggcuacuccggcagcuucguccagcaccccgagcugaccgggcucgacugcauccgccccugcuucuggguggagcugauccggggccgccccaaggaguccaccaucuggaccucgggguccagcaucuccuucugcggcgucaacagcgacacggugggcugguccuggccggacggggccgagcugcccuucaccaucgacaaguga

SEQ ID NO: 28582 - RNA, 1350 nt, Artificial Sequence
  derived and/or modified CDS sequence (AUadapt) from InfluenzaA__BAM85824__NA
augaaucccaaccagaagaucaucaccaucggcucgaucugcauggugaucgggaucgucucccugcuccugcagaucggcaacaugaucagcaucuggaucucccacagcauccagaccgggaaucagcaccaggccgaguccaucagcaacacgaacccgcugaccgagaaggccguggcguccgugacccucgccggcaacagcucccugugccccauccgcgggugggccguccauagcaaggacaacuccauccggaucggcagcaagggcgacguguucgugauccgcgagcccuucaucuccuguagccaccuggagugccggaccuucuuccucacgcagggggcccugcugaacgacaagcauuccaacggcaccgucaaggaccgcagcccccaccggacccucauguccugcccggugggggaggcccccagccccuacaauucccgcuucgagagcguggcguggagcgccuccgccugccacgacggcaccagcuggcugacgaucgggaucuccggccccgauaacggcgccgucgcggugcugaaguacaacgggaucaucaccgacaccaucaagagcuggcggaacaacauccuccgcacccaggaguccgagugugccugcgugaacggcagcugcuucacggucaugaccgacgggccguccaacggccaggccaguuacaagaucuucaagauggagaagggcaagguggugaaguccgucgagcuggacgcccccaacuaccacuacgaggaguguagcugcuaccccgacgccuccgagaucacgugcgugugccgggacaauuggcacgggagcaaccgccccuggguguccuucaaccagaaccuggaguaccagaucggcuauaucugcagcggggucuucggcgacaacccgcggcccaacgacgggaccggcuccuguggccccauguuccccaacggggcguacggcaucaagggguucagcuucaaguacggcaaugggguguggaucggccgcaccaaguccaccaacagccgguccggcuucgagaugaucugggacccgaacggguggaccggcaccgacagcaguuucuccgugaagcaggacaucgucgccaucacggacuggagcggguacuccggcagcuucgugcagcaucccgagcucaccgggcuggacugcauccgccccugcuucuggguggagcugauccggggccgccccaaggaguccaccaucuggaccagcggcuccagcaucuccuucuguggggucaacagcgacacgguguccuggagcuggccggacggcgccgagcuccccuucaccaucgacaaguga

SEQ ID NO: 28583 - RNA, 1350 nt, Artificial Sequence
  derived and/or modified CDS sequence (AUadapt) from InfluenzaA__BAM85825__NA
augaaucccaaccagaagaucaucaccaucggcucgaucugcauggugaucgggaucgucucccugaugcuccagaucggcaacaugaucagcaucugggugucccacagcauccagaccgggaaccagaaucagguggagccgaucaucaacacgaacuuccugaccgagaaggccgucgccuccaucacccuggcgggcaacagcucccucugccccauccgcgggugggccauccacagcaaggacaauuccauccggaucggcagcaagggcgacguguucgugauccgcgagcccuucaucuccugcagccaccuggagugccggaccuucuuucugacgcagggggcccuccugaacgacaagcacuccaacggcaccgucaaggaccgcagcccccaccggacccugauguccugcccggugggggaggcccccagucccuacaacucccgcuucgagagcguggccugguccgcgagcgccugccacgacggcaccagcuggcucacgaucgggaucuccggccccgauaacggcgccgucgccgugcugaaguacaacgggaucaucaccgacaccaucaagagcuggcggaacaacauccugcgcacccaggaguccgagugcgcgugcgugaauggcagcugcuucacggucaugaccgacgggccguccaacggccaggccucguacaagaucuucaagauggagaagggcaaggugaucaaguccguggagcucgacgcccccaauuaccacuacgaggagugcagcugcuaccccgacgccggggagaucacgugugucugccgggacaacuggcacggcuccaaccgccccugggugagcuucaaccagaaccuggaguaucagaucggguacaucugcuccggcguguucggggacaacccgcggcccaacgacggcaccggcagcugcgggcccgucucccauaacggcgccuacggggugaagggcuucagcuucaaguacgggaacggcguguggaucggccgcaccaagucccccaacagucgguccggguucgagaugaucugggacccgaacggcuggagcgagaccgacuccagcuucagcgucaagcaggacaucguggcgaucaccgauugguccggguacagcggcuccuucgugcagcaccccgagcugaccgggcucgacugcauccgccccugcuucugggucgagcugauccggggccgccccaaggagagcacgguguggaccuccggcaguuccaucagcuucugcggggucaacuccgacaccgugagcugguccuggccggacggcgccgagcugcccuucaccaucgacaaguga

SEQ ID NO: 28584 - RNA, 1350 nt, Artificial Sequence
  derived and/or modified CDS sequence (AUadapt) from InfluenzaA__BAM85826__NA
augaaucccaaccaaaagaucaucaccaucggcagcaucugcauggugaucgggaucgucucccugaugcuccagaucggcaacaugaucagcaucugggugucccacagcauccagaccgggaaucagcgccaggccgagccgaucuccaacacgaaguuccugaccgagaaggccguggcgagcgucacccuggccggcaacuccagccucugccccaucuccgggugggccguguacaguaaggacaacuccauccggaucggcagccgcggcgacguguucgucauccgggagcccuucaucuccugcagccaucuggaaugccgcaccuucuuccugacgcagggggcccuccugaacgacaagcacuccaacggcaccgugaaggaucggagcccccaccgcacccugauguccugcccggugggggaggcccccagccccuacaacucccgguucgagagugucgcguggagcgccuccgccugccacgacggcaccagcuggcucacgaucgggaucuccggccccgacaacggcgccguggcggugcugaaguacaaugggaucaucaccgacaccaucaagagcuggcgcaacaacauccugcggacccaggaguccgagugcgccugcgucaacggcaguugcuucacggugaugaccgacgggccguccaacggccaggccagcuacaagaucuucaaaauggagaagggcaagguggucaaguccguggagcucgacgcccccaauuaccacuacgaggagugcagcugcuaccccgaugccggggagaucacgugcgugugccgcgacaacuggcacggcuccaaccggcccugggucagcuuuaaccagaaccuggaguaccagaucggguacaucugcuccggcguguucggggacaacccgcgccccaaugacggcaccggcagcugcgggcccgugucccugaacggcgcguacggggucaagggcuucagcuuuaaauacgggaacggcguguggaucggccggaccaaguccaccaacagccgcuccggguucgagaugaucugggaccccaacggcuggaccgggaccgauagcagcuucuccgugaagcaggacaucgucgccaucacggacuggagcggcuacuccgggagcuuugugcagcacccggagcucaccggccuggacugcauccggcccugcuucugggucgagcugauccgcggccggcccaaggaguccaccaucuggaccagcggguccagcaucuccuuuugcggcgugaacagcgacacgguguccuggagcuggcccgacggggccgagcucccguucaccaucgacaaguga

SEQ ID NO: 28585 - RNA, 1350 nt, Artificial Sequence
  derived and/or modified CDS sequence (AUadapt) from InfluenzaA__BAM85827__NA
augaaucccaaccagaagaucaucaccaucggcagcaucugcauggugaucggggucgugucccugaugcuccagaccggcaacaucaucagcaucugggugucccauagcauccagaaggggaaccagcaccaggccgaguccaucagcaacacgaauccgcugaccgagaaggccgucgcguccgugacccuggccggcaacagcucccucugccccauccgcgggugggccgugcacagcaaggacaauaacauccggaucggcuccaagggcgacgucuucgugauccgcgagcccuucaucagcuguucccaccuggagugccggaccuucuuccugacgcagggggcccuccugaacgauaagcacagcaacggcaccgugaaggaccgcagcccccaccggacccugaugaguugcccggucggggaggcccccucccccuacaacagccgcuucgaguccguggcguggagugccagcgccugccacgacggcaccuccuggcucacgaucgggaucagcggccccgacaaugaggccguggcgguccugaaguacaacggcaucaucaccgacaccaucaaguccuggcggaacaacauccugcgcacccaggagagugagugcgccugcgugaacggguccugcuucacggugaugaccgauggcccgagcaacgggcaggccuccuacaagaucuucaagauggagaagggcaaggucgugaaguccguggagcucgacgcccccaacuaucacuacgaggagugcuccugcuaccccgaugccggcgagaucacgugcgucugccgggacaacuggcacgggaguaaccgccccuggguguccuucaaccagaaccuggaguaccagaucggcuacaucuguagcgggguguucggcgacaacccgcggcccaacgaugggaccggcuccugcggccccaugagccccaacggggcguacggcgucaagggguucuccuucaaguauggcaacgggguguggaucggccgcaccaagagcaccaccucccggagcggcuucgagaugaucugggacccgaauggguggaccggcacggacuccagcuucagcgugaagcaggacaucgucgccaucaccgauugguccggguacagcggcuccuucgugcagcaccccgagcugaccgggcucgacugcauccgccccuguuucugggucgagcugauccggggccgccccaaggagagcaccaucuggacguccggcagcuccaucagcuucugugggguggacuccgacaccgugagcugguccuggccggacggcgccgagcugcccuucaccaucgacaaguga

SEQ ID NO: 28586 - RNA, 1350 nt, Artificial Sequence; identical to SEQ ID NO: 16385
  derived and/or modified CDS sequence (AUadapt) from InfluenzaA__BAM85828__NA

SEQ ID NO: 28587 - RNA, 1350 nt, Artificial Sequence
  derived and/or modified CDS sequence (AUadapt) from InfluenzaA__BAM85829__NA
augaaucccaaccaaaagaucaucaccaucggcagcaucugcaugaucaucgggaucgugucccugaugcuccagaucggcaacaucaucagcaucugggucucccacagcauccagaccgggaaucagcaccaggccgagccgaucuccgacacgaacuuccugaccgagaaggccguggcgagcgugauccuggccggcaacuccagccucugucacaucuccgggugggccguccacagcaaggacaacuccauccgcaucggcagcaagggcgacguguucgugauccgggagcccuuuaucuccugcagccaccuggaaugccgcaccuucuuccugacccagggggcccuccugaacgauaagcacuccaacggcacggucaaggaccggagcccccaccgcacccugauguccugccccgugggggaggccccgagccccuacaauucccgguucgagagcguggcguggagcgccuccgccugccacgacggcaccagcuggcucaccaucgggaucuccggccccgauaacggcgccgucgcggugcugaaguacaacgggaucaucacggacaccaucaagagcuggcgcaacuacauccugcggacccaggaguccgagugcgccugugugaacggcagcugcuucaccgucaugacggacgggcccuccaacggccaggccagcuauaagaucuucaaaaucgagaagggcaagguggugaaguccgucgagcucgacgccccgaacuaccacuacgaggagugcaguugcuaccccgacgccggggagaucacgugcgugugccgcgacaacuggcacggcuccaaucggcccugggugagcuucaaccagaaccuggaguaccagaucggguacaucugcuccggcgucuuuggggacacgccccgcccgaacgacggcaccggcagcugcgggcccgugucccccaacggcgcguacggggugaagggcuucaguuucaaauacgggaacggcgucuggaucggccggaccaaguccaccaacagccgcuccggguucgagaugaucugggaccccaauggcuggaccgggaccgacagcagcuucuccgugaagcaggaccugguggccaucaccgacuggagcggcuacuccgggaguuucguccagcacccggagcucaccggccuggacugcauccggcccugcuucuggguggagcugauccgcggccggcccaaggaguccaccaucuggaccagcggguccaguaucuccuucugcggcgucaacagcgacacgguggggugguccuggcccgacggcgccgagcucccguucaccaucgacaaguga

SEQ ID NO: 28588 - RNA, 1413 nt, Artificial Sequence
  derived and/or modified CDS sequence (AUadapt) from InfluenzaA__BAM85830__NA
augaaccccaaccagaagaucaucaccaucggcucgaucugcauggccaucgggaccaucucccugauccuccagaucggcaacaucaucagcaucuggaucucccacucgauccagacggggucccagaaccacaccggcaucugcaaccagcgcaucaucaccuacgagaacaacaccugggugaaccagacguacgucaacaucagcaacaccaacgugguggccgggaaggacaccaccuccaugauccuggcgggcaacucgucccugugcccgauccggggcugggccaucuacagcaaggacaacuccauccgcaucgggagcaagggcgacgucuucgugauccgggagcccuucaucuccugcucgcaccucgagugccgcacguucuuccugacccagggggcccugcucaacgacaagcacuccaacggcaccgugaaggaccggagccccuaccgcgcccugauguccugccccaucggggaggccccgucgcccuacaacucccgguucgagagcgucgcguggucggccuccgccugccacgacggcaugggcuggcugaccaucgggaucagcggccccgacgacggggccguggcggugcucaaguacaacggcaucaucacggagaucaucaaguccuggcgcaagcagauccugcggacccaggagagcgagugcgucugcgugaacggcuccugcuucaccaucaugaccgacgggcccucgaacggcccggccuccuaccgcaucuucaagaucaagaaggggaagaucaccaagagcaucgagcuggacgcccccaacucccacuacgaggagugcucgugcuaccccgacacgggcaaggugaugugcgucugccgggacaacuggcacggguccaaccgccccugggugagcuucaaccagaaccucgacuaccagaucggcuacaucugcuccggcguguucggggacaacccgcggcccaaggacggcaaggggucgugcgaccccgucaacguggacggcgccgacggggugaagggcuucuccuaccgcuacggcaacggggucuggaucggccggaccaagagcaacuccagccgcaagggguucgagaugaucugggaccccaacggcuggaccgacacggacgggaacuuccuggugaagcaggacguggucgccaugaccgacugguccggcuacucgggcagcuucgugcagcacccggagcugaccgggcucgacugcaugcggcccugcuucuggguggagcugauccgcggccagccccgggagaagaccacgaucuggaccuccgggucguccaucagcuucugcggcgucaacuccgacaccgugaacuggagcuggcccgacggcgcggagcugccguucaccaucgacaaguga

SEQ ID NO: 28589 - RNA, 1413 nt, Artificial Sequence
  derived and/or modified CDS sequence (AUadapt) from InfluenzaA__BAM85831__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcgugugcaaccagcgcaucaucaccuacgagaacuccaccugggucaaccacaccuacgugaacaucaacaacacgaacgugaucgcggggaaggacaagaccucggucacccuggccggcaacuccagccugugcuccaucucgggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaucggcuggcucaccaucgggaucucgggccccgacaacggggcgguggccguccugaaguacaacggcaucaucacggagaccaucaaguccuggaagaagcagauccugcgcacccaggagagcgagugcgugugcgugaacggcuccugcuucaccaucaugacggacgggcccucgaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgggacaacuggcacgggucgaaccgccccugggucuccuucaaccagaaccuggacuaccagaucggcuacaucugcagcggcguguucggggacaacccccggccccgcgacggcgagggguccugcaacccggugacggcggacggcgccaacggggucaagggcuucucguacaaguacggcaacgggguguggaucggccggaccaaguccaaccgccugcggaagggguucgagaugaucugggaccccaacggcuggaccgacaccgacagcgacuucuccgugaagcaggacgucguggccaucacggacuggucgggguacagcggcuccuucgugcagcaccccgagcucaccggccuggggugcauccgccccugcuucugggucgagcuggugcggggccucccgcgcgagaacaccaccaucuggacgucgggguccagcaucuccuucugcggcgucaacagcgacaccgccaacugguccuggcccgacggcgccgagcugcccuucaccaucgacaaguga

SEQ ID NO: 28590 - RNA, 1413 nt, Artificial Sequence; identical to SEQ ID NO: 23910
  derived and/or modified CDS sequence (AUadapt) from InfluenzaA__BAM85832__NA

SEQ ID NO: 28591 - RNA, 1410 nt, Artificial Sequence
  derived and/or modified CDS sequence (AUadapt) from InfluenzaA__BAM85833__NA
augaaccccaaccagaagaucaucaccaucggcucgacgugcauggugaucgggaucaucucccugauccuccagaucggcaacaucaucagcaucugggucucccacagcauccagaccgggaaccagaaccagccggagaccugcaaccaguccgugaucaccuacgagaacaagaccugggugaaccagacguacgucaacaucagcaacaccaaccuggugaucgagcgcgacgugaucuccgucgcccugcucggcaacagcucccugugccccaucagcgggugggccaucuacuccaaggacaacggcauccggaucggcagcaagggggacguguucgugauccgcgagcccuucaucuccugcucgcaccuggagugccggaccuucuuccucacccagggcgcgcugcugaacgacaagcacuccaacgggacggucaaggaccgcagccccuaccggacccucauguccugcccggugggcgaggcccccagccccuacaacucccgcuucgagagcguggccuggagcgccuccgccugccacgacgggaucagcuggcugaccgucggcaucuccggccccgacaacggggcgguggccgugcugaaguacaacggcaucaucaccgacacggucaagagcuggcggaacaacauccuccgcacccaggaguccgagugcgccugcaucaacgggucgugcuucaccaucaugaccgacggcccguccaacggccaggccagcuacaagaucuucaagaucgagaaggggaagguggugaaguccgucgagcugaacgcgcccaacuaccacuacgaggagugcagcugcuaccccgacgccuccgagaucaugugcgugugccgggacaacuggcacggcagcaaccgccccuggguguccuucaaccggaaccuggaguaccagaucggguacaucugcagcggcgucuucggggacaacccgcgccccaacgacggcacgggcuccugcgggcccgugagcuccaacggcgccuacggggugaagggcuucagcuucaaguacgggaagggcgucuggaucggccggaccaaguccaccucgagccgcuccggguucgagaugaucugggaccccaacggcuggaccgagacggacagcuccuucagcgugaagcaggacaucgucgccaucaccgacugguccggguacagcggcuccuucgugcagcacccggagcucaccgggcuggacugcauccggcccugcuucuggguggagcugauccgcggccggcccaaggagaacaccaucuggacgagcggcuccagcaucuccuucugcggggucaacagcgacaccgugggcugguccuggcccgacggggccgagcucccguucaccaucgacaaguga

SEQ ID NO: 28592 - RNA, 1410 nt, Artificial Sequence
  derived and/or modified CDS sequence (AUadapt) from InfluenzaA__BAM85834__NA
augaaccccaaccagaagaucaucaccaucggcucggugucccugaccgucgccacggugugcuuccucaugcagaucgccauccugaccaccaccgugacgcugcacuucaagcagaacgagugcucgaucccggcgaacaaccaggucaugcccugcgagcccaucgugaucgagcgcaacaucaccgagaucguguaccucaacaacaccaccaucgagaaggagaucugccugaaggccgccgaguaccggaacugguccaagccccagugccagaucacgggguucgccccguucagcaaggacaacuccauccgccugucggccggcggggacaucugggucacccgggagcccuacguguccugcgaccccagcaagugcuaccaguucgcgcucggccaggggaccacccuggagaacaagcacuccaacggcacgauccacgaccgcaucccccaccggacccugcucaugaacgagcugggcgugccguuccaccuggggaccaagcaggucugcaucgccuggucguccucguccugccacgacggcaaggccuggcuccacgugugcgugaccggggacgaccgcaacgccacggcgagcuucaucuacgacggcaugcuggucgacuccaucgggucguggucccagaacauccugcggacccaggagagcgagugcgugugcaucaacgggaccugcgccguggucaugaccgacggcuccgccucgggccgcgccgacacgcggauccucuucauccgcgagggcaagaucgugcacaucagcccccuguccgggucggcccagcacaucgaggagugcuccugcuacccccgguaccccaucauccgcugcgugugccgggacaacuggaagggcucgaaccgcccggucaucgacaucaacauggcggacuacuccaucgacagcuccuacgugugcucgggccuggugggggacacgccccggaacgacgacuccagcuccucguccaacugccgcgaccccaacaacgagcggggcaaccccggggucaagggcugggccuucgacaacgggaacgacguguggaugggccgcaccaucagcaaggacucccggucgggcuacgagaccuuccgcgugaucgggggcugggccaccgccaacuccaagucgcagaccaaccggcaggucaucguggacaacaacaacugguccggguacagcggcaucuucucggucgaguccaagagcugcaucaaccgcugcuucuacguggagcucauccgcgggcggccgcaggagacccgcgugugguggaccuccaacucgaucgucguguucugcggcacguccggcaccuacgggaccggcagcuggcccgacggggccaacaucaacuucaugcccaucuga

SEQ ID NO: 28593 - RNA, 1410 nt, Artificial Sequence
  derived and/or modified CDS sequence (AUadapt) from InfluenzaA__BAM85835__NA
augaaccccaaccagaagaucaucaccaucggcucggugucccugaccaucgccacggucugcuuccucaugcagaucgccauccuggcgaccaccgugacccugcacuucaagcagaacgagugcucgaucccggccaacaaccaggugguccccugcgagcccaucaucaucgagcgcaacaucacggagaucguguaccucaacaacaccaccaucgagaaggagaucugcuccaaggccguggacuaccggaacuggagcaagccccagugccagaucaccggguucgccccguucuccaaggacaacucgauccgccuguccgccggcggggacaucugggucacgcgggagcccuacgugagcugcgacaccuccaagugcuaccaguucgcgcugggccaggggaccacccucgacaacaagcacucgaacggcacgauccacgaccgcaucccccaccggacccugcugaugaacgagcucggcgugcccuuccaccuggggaccaagcaggucugcaucgccugguccagcuccucgugccacgacggcaaggccuggcugcacgugugcgugaccggggacgaccgcaacgccacggcguccuucaucuacaacggcaugcucgucgacagcaucggguccuggucgcagaacauccugcggacccaggaguccgagugcgugugcaucaacggcucgugcaccguggucaugaccgacggcagcgccuccgggaaggccgacacgcgcauccuguucgugaaggagggcaagaucauccacaucucgccgcucuccgggagcgcccagcacaucgaggagugcuccugcuacccccgguaccccaacgugcgcugcgucugccgggacaacuggcgcggcucgaaccggcccgugaucgacaucaacauggccgacuacuccaucgacagcuccuacgugugcucgggccuggucggggacaccccgcgcaacgacgacaacuccagcuccucgaacugccgggaccccaacaacgagcgcggcaaccccggggugaagggcugggcguucgacuccggggacgacguguggaugggccggaccaucucgcgcgacucccggagcggcuacgagaccuucaaggucaucgggggcugggccacggccaacuccaagucgcagaccagccgccaggugaucgucgacaacaacaacugguccggguacucgggcguguucuccguggagcacaagagcugcaucaaccggugcuucuacgucgagcugauccgcgggcgcccccaggagacccgggugugguggaccuccaacucgaucguggucuucugcggcacguccggcaccuacgggaccggcagcuggccggacggggccaacaucaacuucaugcccaucuga

SEQ ID NO: 28594 - RNA, 1410 nt, Artificial Sequence
  derived and/or modified CDS sequence (AUadapt) from InfluenzaA__BAM85836__NA
augaaccccaaccagaagaucaucaccaucggcucggugucccugaccaucgccacgaucugcuuccucaugcagaucgccauccuggcgaccaccgucacccugcacuucaagcagaacgggugcagcaucccguccaacaaccagguggugcccugcgagcccaucaucgucgagcgcaacaucacggagaucguguaccucaacaacaccaccaucgagaaggagcugugccccaaggugcuggaguaccgggacuggucgaagccgcagugccagaucaccggcuucgcccccuucuccaaggacaacagcauccgccucuccgccgggggcgacaucugggucacgcgggagcccuacgugucgugcucccccgacaagugcuaccaguucgcccuggggcagggcaccacccuggacaaccgccacagcaacggcaccauccacgaccggaucccgcaccgcacgcuccugaugaacgagcugggggugcccuuccaccucggcaccaagcaggucugcaucgccugguccucguccagcugccacgacgggcgggcguggcugcacgugugcgugaccggcgacgaccgcaacgccaccgccuccuucaucuacgacgggaugcuggucgacucgaucggcuccuggagccagaacauccuccggacgcaggaguccgagugcgugugcaucaacgggaccugcaccguggucaugaccgacggcucggccagcggccgcgcggacacgcggauccuguucgugaaggaggggaagaucgugcacaucucgccccuguccggcuccgcccagcacaucgaggagugcagcugcuacccccgcuacccggacguccggugcgugugccgcgacaacuggaagggcuccaaccggcccaucaucgacaucaacauggccgacuacucgaucggguccagcuacgugugcuccggccucgucggggacacgccccgcaacgacgacucguccagcaacuccaacugccgggaccccaacaacgagcgcggcaacccgggggugaagggcugggccuucgacuacggcaacgacguguggauggggcggaccaucucgaaggacucccgcagcggcuacgagaccuuccgggucaucgggggcuggaccaccgccaacuccaagucgcaggugaaccgccaggucaucguggacaacuccaacuggagcggguacucgggcaucuucuccguggagggcaagagcugcaucaaccgcugcuucuacgucgagcugauccgggggcgcccccaggagacccgggugugguggaccuccaacucgaucguggucuucugcggcacguccgggaccuacggcaccgggagcuggcccgacggcgcgaacaucaacuucaugcccaucuga

SEQ ID NO: 28595 - RNA, 1410 nt, Artificial Sequence
  derived and/or modified CDS sequence (AUadapt) from InfluenzaA__BAO79717__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccucguccugccacgacggcaaggccuggcugcacgugugcaucaccggggacgacaagaacgcgaccgccagcuucaucuacaacggccggcucguggacuccguggucucgugguccaaggacauccugcgcacccaggagagcgagugcgugugcaucaacgggacgugcaccguggucaugaccgacggcuccgccucgggcaaggccgacaccaagauccuguucaucgaggaggggaagaucgugcacacgagcacccucuccggcucggcgcagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccuggugggggacaccccgcggaagaacgacuccagcuccucgucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagaacugcaucaaccggugcuucuacguggagcugauccgcggccggaaggaggagaccgaggugcucuggaccagcaacucgaucgucguguucugcgggacguccggcaccuacgggaccggcagcuggcccgacggggccgaccugaaccugaugcccaucuga

SEQ ID NO: 28596 - RNA, 1413 nt, Artificial Sequence; identical to SEQ ID NO: 17461
  derived and/or modified CDS sequence (AUadapt) from InfluenzaA__CAA33354__NA

SEQ ID NO: 28597 - RNA, 1404 nt, Artificial Sequence
  derived and/or modified CDS sequence (AUadapt) from InfluenzaA__CAB95858__NA
augaaccccaaccagaagaucaucgcccugggcucgguguccaucaccaucgccaccaucugccuccugaugcagaucgcgauccuggccacgaccaugacccuccacuucaacgagugcaccaacccgucgaacaaccaggccaugcccugcgagcccaucaucaucgagcgcaacaucacggagaucguccaccugaacaacaccaccaucgagaaggaguccugccccaagguggccgaguacaagaacuggucgaagccgcagugccagaucaccggguucgcccccuucuccaaggacaacucgauccggcuguccgcgggcggggacaucugggugacgcgcgagcccuacgucucgugcggccucgggaacugcuaccaguucgcccugggccagggcaccacccugaacaacaagcacuccaacgggaccauccacgaccggagcccccaccgcacgcuccugaugaacgagcugggcgugccguuccaccucgggaccaagcaggucugcaucgccugguccucguccucgugccacgacggcaaggccuggcugcacgugugcgugaccggggacgaccggaacgcgaccgccuccaucaucuacgacggcaugcugacggacucgaucggcuccuggucgaagaacauccuccgcacccaggaguccgagugcgugugcaucaacgggaccugcaccgucgugaugacggacggcagcgccucggggcgggccgacaccaagauccuguucauccgcgagggcaagaucgugcacaucucgccccuguccggcuccgcccagcacgucgaggagugcucgugcuacccccgguaccccgaggugcgcugcgugugccgggacaacuggaagggguccaaccgcccgguccucuacaucaacguggcggacuacucgguggacuccagcuacgucugcuccggccuggugggggacacgccccggaacgacgacucguccucguccucgaacugccgcgaccccaacaacgagcggggcgggcccggcgugaagggcugggccuucgacaacgggaacgacgucuggaugggccgcaccaucaagaaggacucccggucgggguacgagaccuuccgcguggugggcggguggaccaccgccaacuccaagagccagaucaaccggcaggucaucguggacuccgacaacuggucgggcuacucgggcaucuucuccgucgaggggaagaccugcaucaaccgcugcuucuacguggagcugauccggggccgcccgcaggagacgcgcgugugguggaccucgaacuccaucaucgucuucugcgggaccucgggcaccuacgggacgggcuccuggcccgacggcgccaacaucaacuucaugagcaucuga

SEQ ID NO: 28598 - RNA, 1404 nt, Artificial Sequence
  derived and/or modified CDS sequence (AUadapt) from InfluenzaA__CAB95859__NA
augaaccccaaccagaagaucaucgcccugggcucgguguccaucaccaucgccaccaucugccuccugaugcagaucgcgauccuggccacgaccaugacccuccacuucaacgagugcaccaacccgucgaacaaccaggccguccccugcgagcccaucaucaucgagcgcaacaucacggagaucgugcaccugaacaacaccaccaucgagaaggaguccugccccaagguggccgaguacaagaacuggucgaagccgcagugccagaucaccggguucgcccccuucuccaaggacaacucgauccggcuguccgcgggcggggacaucugggucacgcgcgagcccuacgugucgugcggccucgggaagugcuaccaguucgcccugggccagggcaccacccugaacaacaagcacuccaacgggaccauccacgaccggucgccccaccgcacgcuccugaugaacgagcugggcgugccguuccaccucgggaccaagcaggucugcaucgccugguccagcuccucgugccacgacggcaaggccuggcugcacgugugcgugaccggggacgaccggaacgcgaccgccuccaucaucuacgacggcaugcugacggacucgaucggcuccuggucgaagaacauccuccgcacccaggaguccgagugcgucugcaucaacgggaccugcaccguggugaugacggacggcucggccucggggcgggccgacaccaagauccuguucauccgcgagggcaagaucguccacaucggcccccuguccgggagcgcccagcacguggaggagugcuccugcuacccccgguaccccgaggugcgcugcgucugccgggacaacuggaagggcucgaaccgcccggugcucuacaucaacguggcggacuacuccgucgacucguccuacgugugcucggggcuggugggcgacacgccccggaacgacgacuccucguccucguccaacugccgcgaccccaacaacgagcgcgggggccccggcgucaaggggugggccuucgacaacggcaacgacguguggauggggcggaccaucaagaaggacagccgguccggcuacgagaccuuccgcguggucgggggcuggaccaccgccaacucgaagucccagaucaaccgccaggugaucgucgacucggacaacugguccggcuacucggggaucuucucgguggagggcaagaccugcaucaaccggugcuucuacguggagcugauccgggggcgcccgcaggagacgcgcgucugguggaccuccaacucgaucaucguguucugcggcaccuccgggaccuacggcacgggcagcuggcccgacggggccaacaucaacuucauguccaucuga

SEQ ID NO: 28599 - RNA, 1410 nt, Artificial Sequence; identical to SEQ ID NO: 16975
  derived and/or modified CDS sequence (AUadapt) from InfluenzaA__CAC19707__NA

SEQ ID NO: 28600 - RNA, 1410 nt, Artificial Sequence
  derived and/or modified CDS sequence (AUadapt) from InfluenzaA__CAD29959__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacucgaacgacaccguccacgaccgcaccccguaccggacccuccugaugaacgagcugggcgugcccuuccaccucgggacgaagcaggucugcaucgccugguccagcuccucgugccacgacggcaaggcguggcugcacgugugcgugaccggggacgacgagaacgccaccgccuccuucaucuacaacggccgccugguggacagcaucggguccuggucgaagaagauccuccggacccaggaguccgagugcgucugcaucaacggcacgugcaccguggugaugaccgacggcucggccuccgggaaggcggacaccaagauccuguucaucgaggagggcaagaucguccacacgagcccccugucgggguccgcccagcacguggaggagugcucgugcuacccccgcuacccgggcgugcggugcgucugccgcgacaacuggaagggcuccaaccggcccaucguggacaucaacgugaaggacuacagcaucgucuccucguacgugugcuccgggcucgugggcgacacgccccgcaagaacgacagcuccucguccucgcacugccugaaccccaacaacgaggagggcgggcacggggucaagggcugggccuucgacgacggcaacgacguguggauggggcggaccaucuccgagaagcugcgcagcggcuacgagaccuucaaggucaucgaggggugguccaagccgaacucgaagcuccagaucaaccgccaggugaucguggaccggggcaaccgguccggguacucgggcaucuucuccgucgagggcaagagcugcaucaaccgcugcuucuacguggagcugauccgggggcgcaagcaggagaccgaggugcuguggaccucgaacuccaucgucguguucugcggcaccagcgggaccuacggcacgggguccuggcccgacggcgccgacaucaaccucaugcccaucuga

SEQ ID NO: 28601 - RNA, 1410 nt, Artificial Sequence
  derived and/or modified CDS sequence (AUadapt) from InfluenzaA__CAD29960__NA
augaaccccaaccagaagaucaucaccaucggcucggugucccugaccaucgccacgaucugcuuccucaugcagaucgccauccuggucaccaccgugacccugcacuucaagcaguacgagugcaacccgccgcccaacaaccaggugaugcucugcgagcccacgaucaucgagcgcaacaucaccgagaucgucuaccugaccaacaccacgaucgagaaggagaucugccccaagcuggcggaguaccggaacuggucgaagccccagugcaacaucaccggguucgcccccuucuccaaggacaacagcauccgccucuccgccggcggggacaucugggugacccgggagcccuacgugucgugcgacccggacaagugcuaccaguucgcccugggccaggggaccacgcugaacaacggccacuccaacgacaccguccacgugcgcacccccuaccggacccuccugaugaacgagcugggcgugcccuuccaccucgggacgaagcaggucugcaucgccuggucguccagcuccugccacgacggcaaggcguggcugcacgugugcgugaccggggacgacgagaacgccaccgccucguucaucuacaacggccgccuggucgacuccaucgggagcugguccaagaagauccuccggacccaggagucggagugcgugugcaucaacggcacgugcaccguggucaugaccgacggcuccgccucggggaaggcggacaccaagauccuguucaucgaggagggcaagaucgugcacacgagcccccuguccgggucggcccagcacguggaggagugcuccugcuacccgcgcuaccccggcguccggugcgugugccgcgacaacuggaagggcucgaaccggcccaucguggacaucaacgucaaggacuacuccaucgugagcuccuacgugugcucggggcucgucggcgacacgccccgcaagaacgacuccagcuccucgucccacugccugaacccgaacaacgaggagggcgggcacggggugaagggcugggccuucgacgacggcaacgacgucuggauggggcggaccaucucggagaagcugcgcuccggcuacgagaccuucaaggugaucgagggguggagcaagcccaacuccaagcuccagaucaaccgccaggugaucgucgaccggggcaaccggucgggguacuccggcaucuucucgguggagggcaaguccugcaucaaccgcugcuucuacguggagcugauccgggggcgcaagcaggagaccgagguccuguggaccagcaacucgaucgugguguucugcggcaccuccgggaccuacggcacggggagcuggcccgacggcgccgacaucaaccucaugcccaucuga

SEQ ID NO: 28602 - RNA, 1410 nt, Artificial Sequence
  derived and/or modified CDS sequence (AUadapt) from InfluenzaA__CAD29961__NA
augaaccccaaccagaagaucaucaccaucggcucggugucccugaccaucucgacgaucugcuucuucaugcagaucgccauccucgucaccaccgugacccugcacuucaagcaguacgagugcaacuccccgcccaacaaccaggugaugcugugcgagcccacgaucaucgagcgcaacaccaccgagaucgucuaccucaccaacacgaccaucgagaaggagaucugccccaagcuggccgaguaccggaacuggagcaagccgcagugcaacaucaccggguucgcgcccuucuccaaggacaacucgauccgccuguccgccggcggggacaucugggugacccgggagcccuacgugucgugcgaccccgacaagugcuaccaguucgcccucggccaggggacgacccugaacaacggccacuccaacgacaccguccacgaccgcaccccguaccggacgcugcucaugaacgagcugggcgugcccuuccaccuggggaccaagcaggucugcaucgccuggagcuccucguccugccacgacggcaaggccuggcuccacgugugcgugaccggggacgacgagaacgcgaccgccucguucaucuacaacggccgccugguggacuccaucgggagcugguccaagaagauccugcggacgcaggagucggagugcgucugcaucaacgggaccugcaccguggugaugaccgacggcuccgccucggggaaggccgacacgaagauccucuucaucgaggagggcaagaucguccacaccagcacccuguccgggucggcgcagcacguggaggagugcuccugcuacccccgcuaccccggcgugcggugcgucugccgcgacaacuggaagggcagcaaccggccgaucguggacaucaacaucaaggacuacuccaucgugucguccuacgucugcucggggcuggugggcgacacgccccgcaagaacgacuccagcuccucgucccacugccucgaccccaacaacgaggagggcggccacggggugaagggcugggccuucgacgacggcaacgacgucuggauggggcggaccaucucggagaagcugcgcuccggcuacgagaccuucaaggugaucgagggguggagcaagcccaacuccaagcugcagaucaaccggcaggucaucguggaccgcggcaaccggucgggguacuccggcaucuucucgguggagggcaagagcugcaucaaccgcugcuucuacgucgagcucauccgggggcgcaagcaggagaccgaggugcuguggaccuccaacucgaucguggucuucugcggcacguccgggaccuacggcaccgggagcggcccggacggcgccgacaucaaccugaugcccaucuga

SEQ ID NO: 28603 - RNA, 1410 nt, Artificial Sequence; identical to SEQ ID NO: 23947
  derived and/or modified CDS sequence (AUadapt) from InfluenzaA__CAD29962__NA

SEQ ID NO: 28604 - RNA, 1410 nt, Artificial Sequence; identical to SEQ ID NO: 16686
  derived and/or modified CDS sequence (AUadapt) from InfluenzaA__CAD29963__NA

SEQ ID NO: 28605 - RNA, 1410 nt, Artificial Sequence; identical to SEQ ID NO: 16686
  derived and/or modified CDS sequence (AUadapt) from InfluenzaA__CAD29964__NA

SEQ ID NO: 28606 - RNA, 1410 nt, Artificial Sequence; identical to SEQ ID NO: 16686
  derived and/or modified CDS sequence (AUadapt) from InfluenzaA__CAD29965__NA

SEQ ID NO: 28607 - RNA, 1410 nt, Artificial Sequence; identical to SEQ ID NO: 16686
  derived and/or modified CDS sequence (AUadapt) from InfluenzaA__CAD29966__NA

SEQ ID NO: 28608 - RNA, 1410 nt, Artificial Sequence; identical to SEQ ID NO: 16442
  derived and/or modified CDS sequence (AUadapt) from InfluenzaA__CAD29967__NA

SEQ ID NO: 28609 - RNA, 1410 nt, Artificial Sequence; identical to SEQ ID NO: 16442
  derived and/or modified CDS sequence (AUadapt) from InfluenzaA__CAD29968__NA

SEQ ID NO: 28610 - RNA, 1410 nt, Artificial Sequence; identical to SEQ ID NO: 16975
  derived and/or modified CDS sequence (AUadapt) from InfluenzaA__CAD29969__NA

SEQ ID NO: 28611 - RNA, 1410 nt, Artificial Sequence
  derived and/or modified CDS sequence (AUadapt) from InfluenzaA__CAD29970__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccucguccucgugccacgacgggaaggcguggcugcacgugugcgugaccggccacgacgagaacgccaccgccuccuucaucuacgacgggcggcugguggacagcaucggcuccuggucgaagaagauccuccgcacccaggaguccgagugcgucugcaucaacgggacgugcaccguggugaugaccgacggcagcgccuccggccgggcggacaccaagauccuguucaucgaggaggggaagaucguccacaucucgccccugagcggcuccgcccagcacguggaggagugcucgugcuacccccgcuacccggggauccggugcgugugccgcgacaacuggaagggcuccaaccggcccaucgucgacaucaacgugaaggacuacucgaucguguccagcuacgucugcuccggccucgugggggacacgccccgcaagaacgacucguccagcuccucgcacugccugaaccccaacaacgaggagggcgggcacggcgugaaggggugggccuucgacgacggcaacgacgucuggaugggccggaccaucuccgagaagcugcgcucgggguacgagaccuucaaggugaucgagggcugguccaagccgaacagcaagcuccagaucaaccggcaggucaucguggaccgcgggaaccgguccggcuacucggggaucuucuccguggagggcaagagcugcaucaaccgcugcuucuacgucgagcugauccggggccgcaagcaggagaccgaggugugguggacgucgaacuccaucguggucuucugcgggaccagcggcaccuacgggaccggcuccuggcccgacggggccgacaucaaccugaugcccaucuga

SEQ ID NO: 28612 - RNA, 1410 nt, Artificial Sequence; identical to SEQ ID NO: 18957
  derived and/or modified CDS sequence (AUadapt) from InfluenzaA__CAD29971__NA

SEQ ID NO: 28613 - RNA, 1410 nt, Artificial Sequence
  derived and/or modified CDS sequence (AUadapt) from InfluenzaA__CAD29972__NA
augaaccccaaccagaagaucaucaccaucggcucggugucccugaccaucgccacgaucugcuuccucaugcagaucgucauccuggugaccaccgugacccugcacuucaagcaguacgagugcaacucgccgcccaacaaccaggucaugcucugcgagcccacgaucaucgagcgcaacaucaccgagaucguguaccugaccaacaccacgaucgagaaggagaucugccccaagcuggccgaguaccggaacugguccaagccgcagugcaacaucaccggguucgcgcccuucagcaaggacaacuccauccgccucucggccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgaagcaggucugcaucgccugguccucguccucgugccacgacggcaaggccuggcugcacgugugcgugaccggggacgacaagaacgcgaccgccuccuucaucuacaacggccgccuggucgacagcaucggguccuggucgaagaagauccuccggacccaggaguccgagugcgugugcaucaacggcacgugcgccguggucaugaccgacggcagcgccuccgggaaggcggacaccaagauccuguucaucgaggagggcaagaucgggcacaccucgcugcucagcggcuccgcccagcacguggaggagugcucgugcuacccccgcuaccccggcgugcggugcgucugccgcgacaacuggaagggguccaaccggccgaucguggacaucaacgugaaggacuacucgaucgucuccagcuacgugugcuccggccuggugggggacacgccccgcaagaacgacucguccagcuccucgcacugccuggaccccaacaacgaggagggcgggcacggcgucaagggcugggccuucgacgacgggaacgacguguggaugggccggaccaucuccgagaagcuccgcucgggguacgagaccuucaaggucaucgagggcugguccaagcccaacagcaagcugcagaucaaccgccaggugaucguggaccgggggaaccgguccggcuacucgggcaucuucuccgucgagggcaagagcugcaucaaccgcugcuucuacguggagcugauccgggggcgcaaccaggagaccgagauccucuggacgucgaacuccaucguggucuucugcgggaccagcggcaccuacgggaccggcuccuggccggacggcgccgacaucaaccugaugcccaucuga

SEQ ID NO: 28614 - RNA, 1410 nt, Artificial Sequence
  derived and/or modified CDS sequence (AUadapt) from InfluenzaA__CAD29973__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccuucaucuacgacggccggcugguggacucgaucggguccuggucgaagaagauccuccgcacccaggaguccgagugcgucugcaucaacggcacgugcaccguggugaugaccgacggcagcgccuccgggcgggcggacaccaagauccuguucaucgaggagggcaagaucguccacaucucgccccugagcggguccgcccagcacguggaggagugcucgugcuacccccgcuacuccggcgugcggugcgucugccgcgacaacuggaagggcagcaaccggccgaucguggacaucaacgugaaggacuacuccaucgucucguccuacgugugcagcgggcucgugggcgacacgccccgcaagaacgacuccucguccucgucccacugccugaaccccaacaacgaggagggcgggcacggggucaagggcugggccuucgacgacggcaacgacguguggauggggcggaccaucagcgagaagcugcgcuccggcuacgagaccuucaaggucaucgggggcuggucgaagcccaacuccaagcuccagaucaaccgccaggugaucguggaccgggggaaccggagcggcuacuccggcaucuucucggucgagggcaagagcugcaucaaccgcugcuucuacguggagcugauccgggggcgcaagcaggagaccgaggugugguggacguccaacucgaucgucguguucugcgggaccuccggcaccuacgggaccggcagcuggccggacggcgccgacaucaaccugaugcccaucuga

SEQ ID NO: 28615 - RNA, 1410 nt, Artificial Sequence; identical to SEQ ID NO: 24986
  derived and/or modified CDS sequence (AUadapt) from InfluenzaA__CAD29974__NA

SEQ ID NO: 28616 - RNA, 1410 nt, Artificial Sequence
  derived and/or modified CDS sequence (AUadapt) from InfluenzaA__CAD29984__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcacuacguguccugcgaccgcgacaagugcuaccaguucgcccugggccaggggaccacgcugaacaacggccacagcaacgacaccguccacgaccggacccccuaccgcacccuccugaugaacgagcugggcgugcccuuccaccucgggacgaagcaggucugcaucgccugguccucguccagcugccaccacggcaaggcguggcugcacgugugcgugaccggggacgacgagaacgccaccgccuccuucaucuacaacggccggcugguggacucgaucggguccuggucgaagaagauccuccgcacccaggaguccgagugcgucugcaucaacggcacgugcaccguggugaugaccgacggcagcgccuccgggaaggcggacaccaagauccuguucaucaaggagggcaagaucguccacacgucgagccuguccgggucggcccagcacguggaggagugcuccugcuacccgcgguaccccggcgugcgcugcgucugccgggacaacuggaagggcagcaaccgccccaucguggacaucaacgugaaggacuacuccaucgucucguccuacgugugcagcgggcucgugggcgacacgccccggaagaacgacuccucguccucgucccacugccuggacccgaacaacgaggagggcgggcacggggucaagggcugggccuucgacgacggcaacgacguguggauggggcgcaccaucagcgagaagcugcgguccggcuacgagaccuucaaggucaucgagggguggucgaaggccaacuccaagcuccagaucaaccgccaggugaucguggaccggggcaaccgcagcggguacuccggcaucuucucggucgagagcaaguccugcaucaaccggugcuucuacguggagcugauccgcggccggaagcaggagaccgaggugcuguggaccucgaacuccaucgucguguucugcgggaccagcggcaccuacgggacgggcuccuggcccgacggggccgacaucaaccucaugcccaucuga

SEQ ID NO: 28617 - RNA, 1410 nt, Artificial Sequence
  derived and/or modified CDS sequence (AUadapt) from InfluenzaA__CAD29985__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccagcugccacgacggcaaggcguggcugcacgugugcgugaccggggacgacgagaacgccaccgccuccuucaucuacaacggccgccugguggacucgaucggguccuggagcaagaagauccuccggacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcucgugcuacccccgcuaccccggcgugcggugcgucugccgcgacaacuggaagggcuccaaccggccgaucguggacaucaacgugaaggacuacagcaucgucuccucguacgugugcuccgggcucgugggcgacacgccccgcaagaacgacagcuucuccucgucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggucgaagcccaacuccaagcuccagaucaaccgccaggugaucguggagcggggcaaccggagcggguacuccggcaucuucucggucgagggcaaguccugcaucaaccgcugcuucuacguggagcugauccgggggcgcaaggaggagaccgaggugugguggaccagcaacucgaucgucguguucugcggcaccucccggaccuacgggacgggcagcuggccggacggggccgacaucaaccugaugcccaucuga

SEQ ID NO: 28618 - RNA, 1410 nt, Artificial Sequence
  derived and/or modified CDS sequence (AUadapt) from InfluenzaA__CAD29988__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccagcugccacgacggcaaggcguggcugcacgucugcgugaccggggacgacgagaacgccaccgccuccuucaucuacaacggccggcugguggacucgaucggguccuggagcaagaagauccuccgcacccaggaguccgagugcgucugcaucaacggcacgugcaccguggugaugaccgacggcucggccuccgagaaggcggacaccaagauccuguucaucgaggaggggaagaucguccacaucagcacgcugucgggcuccgcccagcacguggaggagugcucgugcuacccccgguaccccggggugcgcugcgucugccgggacaacuggaagggcuccaaccgcccgaucguggacaucaacgugaaggacuacagcaucgucuccucguacgugugcuccggccucgugggggacacgccccggaagaacgacagcuucuccucgucccacugccuggaccccaacaacgaggagggcgggcacggcgucaaggggugggccuucgacgacggcaacgacguguggaugggccgcaccaucagcgagaagcugcgguccggguacgagaccuucaaggucaucgagggcuggucgaagcccaacuccaagcuccagaucaaccgccaggugaucguggagcgggggaaccgcagcggcuacuccgggaucuucucggucgagggcaaguccugcaucaaccggugcuucuacguggagcugauccgcggccggaaggaggagaccgaggugugguggaccagcaacucgaucgucguguucugcgggaccuccggcaccuacgggacgggcagcuggccggacggggccgacaucaaccugaugcccaucuga

SEQ ID NO: 28619 - RNA, 1410 nt, Artificial Sequence
  derived and/or modified CDS sequence (AUadapt) from InfluenzaA__CAD29990__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacucgaacgacaccguccacggccgcaccccguaccggacccuccugaugaacgagcugggggugcccuuccaccucggcacgaagcaggucugcaucgccugguccagcuccucgugccacgacgggaaggcguggcugcacgugugcgugaccggcgacgacgagaacgccaccgccuccuucaucuacaacgggcgccugguggacagcaucggcuccuggucgaagaagauccuccggacccaggaguccgagugcgucugcaucaacggcacgugcaccguggugaugaccgacgggucggccuccggcaaggcggacaccaagauccuguucaucgaggaggggaagaucguccacacgagccugcucucgggcuccgcccagcacguggaggagugcucgugcuacccccgcuaccccggcgugcggugcgucugccgcgacaacuggaagggguccaaccggccgaucguggacaucaacgugaaggacuacagcaucgucuccucguacgugugcuccggccuggugggggacacgccccgcaagaacgacaacagcuccucgucccacugccuggaccccaacaacgaggagggcgggcacggcgucaagggcugggccuucgacgacgggaacgacguguggaugggccggaccaucucggagaagcuccgcuccggguacgagaccuucaaggucaucgagggcuggagcaagcccaacuccaagcugcagaucaaccgccaggugaucguggaccgggggaaccggucgggcuacuccggcaucuucucggucgaggggaaguccugcaucaaccgcugcuucuacguggagcugauccggggccgcaagcaggagaccgaggugcucuggaccagcaacucgaucgucguguucugcgggaccuccggcaccuacgggacgggcagcuggccggacggcgccgacaucaaccugaugcccaucuga

SEQ ID NO: 28620 - RNA, 1410 nt, Artificial Sequence; identical to SEQ ID NO: 16463
  derived and/or modified CDS sequence (AUadapt) from InfluenzaA__CAD29991__NA

SEQ ID NO: 28621 - RNA, 1410 nt, Artificial Sequence
  derived and/or modified CDS sequence (AUadapt) from InfluenzaA__CAD29992__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacucgaacgacaccguccacgaccgcaccccguaccggacccuccugaugaacgagcugggcgugcccuuccaccucgggacgaagcaggucugcaucgccugguccagcuccucgugccacgacggcaaggcguggcugcacgugugcgugaccggggacgacgagaacgccaccgccuccuucaucuacaacggccgccugguggacagcaucggguccuggucgaagaagauccuccggacccaggaguccgagugcgucugcaucaacggcacgugcaccguggugaugaccgacggcucggccuccgggaaggcggacaccaagauccuguucaucgaggagggcaagaucguccacacgagccugcucucgggguccgcccagcacguggaggagugcucgugcuacccccgcuaccccggcgugcggugcgucugccgcgacaacuggaagggcuccaaccggccgaucguggacaucaacgugaaggaccgcagcaucgucuccucguacgugugcuccgggcuggugggcgacacgccccggaagaacgacagcuccucguccucgcacugccuggaccccaacaacgaggagggcgggcacggggucaagggcugggccuucgacgacggcaacgacguguggauggggcgcaccaucuccgagaagcuccggagcggcuacgagaccuucaaggucaucgaggggugguccaagcccaacucgaagcugcagaucaaccgccaggugaucguggaccggggcaaccgcuccggguacucgggcaucuucuccgucgagggcaagagcugcaucaaccggugcuucuacguggagcugauccgcgggcggaagcaggagaccgaggugcucuggaccucgaacuccaucgucguguucugcggcaccagcgggaccuacggcacgggguccuggccggacggcgccgacaucaaccugaugcccaucuga

SEQ ID NO: 28622 - RNA, 1410 nt, Artificial Sequence
  derived and/or modified CDS sequence (AUadapt) from InfluenzaA__CAD29993__NA
augaaccccaaccagaagaucaucaccaucggcucggugucccugaccaucgccacgaccugcuuccucaugcagaucgccauccuggucaccaccgugacgcugcacuucaagcaguacgagugcaacucgccgcccaacaaccaggugaugcucugcgagcccaccaucaucgagcgcaacaucaccgagaucgucuaccugaccaacacgaccaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggacgacccugaacaacggccacucgaacgacaccguccacgaccgcaccccguaccggacgcuccugaugaacgagcugggcgugcccuuccaccucgggaccaagcaggucugcaucgccugguccagcuccucgugccacgacggcaaggcguggcugcacgugugcgugaccggggacgacgagaacgccaccgccuccuucaucuacaacggccgccugguggacucgaucggguccuggagcaagaagauccuccggacgcaggaguccgagugcgucugcaucaacgggaccugcaccguggugaugaccgacggcucggccuccgggaaggcggacacgaagauccuguucaucgaggagggcaagaucguccacaccucgccccugagcggguccgcccagcacguggaggagugcucgugcuacccccgcuacccgggcgugcggugcgucugccgcgacaacuggaagggcuccaaccggcccaucguggacaucaacgugaaggacuacucgaucgucuccagcuacgugugcuccgggcucgugggcgacacgccccgcaagaacgacucguccucguccagccacugccuggaccccaacaacgaggagggcggccacggggucaagggcugggccuucgacgacggcaacgacguguggauggggcggaccaucuccgagaagcugcgcucgggcuacgagaccuucaaggucaucgaggggugguccaagccgaacucgaagcuccagaucaaccgccaggugaucguggaccggggcaaccgguccggguacagcggcaucuucuccgucgagggcaagucgugcaucaaccgcugcuucuacguggagcugauccgggggcgcaagcaggagaccgaggugcuguggaccucgaacuccaucgucguguucugcggcaccagcgggacguacggcaccggguccuggcccgacggcgccgacaucaaccucaugcccaucuga

SEQ ID NO: 28623 - RNA, 1410 nt, Artificial Sequence; identical to SEQ ID NO: 18151
  derived and/or modified CDS sequence (AUadapt) from InfluenzaA__CAD29994__NA

SEQ ID NO: 28624 - RNA, 1413 nt, Artificial Sequence; identical to SEQ ID NO: 18855
  derived and/or modified CDS sequence (AUadapt) from InfluenzaA__CAD57252__NA

SEQ ID NO: 28625 - RNA, 1413 nt, Artificial Sequence
  derived and/or modified CDS sequence (AUadapt) from InfluenzaA__CAD57253__NA
augaaccccaaccagaagaucaucaccaucggcucgauccgcaucgccaucgggaucaucucccugaugcuccagaucggcaacaucaucagcaucugggccucccacucgauccagaccgggucccagaaccacacgggcgugugcaaccagcggaucaucaccuacgagaacagcaccugggucaaccacaccuacgugaacaucaacaacacgaacgugaucgcggggaaggacaagaccuccgucacccuggccggcaacucgucccugugcagcaucuccggcugggccaucuacaccaaggacaacucgauccgcaucggguccaagggcgacguguucgugauccgggagccguucaucagcugcucccaccucgagugccgcacguucuuccugacccagggggcccugcucaacgacaagcacucgaacggcaccgucaaggaccggucccccuaccgcgcccugaugagcugcccccugggggaggcgcccuccccguacaacucgaaguucgagagcguggccugguccgccagcgccugccacgacggcaugggcuggcucaccaucgggaucuccggccccgacaacggggcgguggccguccugaaguacaacggcaucaucacggagaccaucaagucguggaagaagcagauccugcggacccaggaguccgagugcgugugcgugaacggcagcugcuucaccaucaugacggacgggcccuccaacggcgccgccucguacaagaucuucaagaucgagaaggggaagaucaccaaguccaucgagcucaacgcccccaacuuccacuacgaggagugcagcugcuacccggacaccggcaccgucaugugcgugugccgcgacaacuggcacggguccaaccggcccugggugucguucaaccagaaccuggacuaccagaucggcuacaucugcuccggcgucuucggggacaacccccgccccaaggacggcgaggggagcugcaacccggugacgguggacggcgcgaacggggucaagggcuucuccuacaaguacggcaacgggguguggaucggccggaccaagucgaaccgccugcggaagggguucgagaugaucugggaccccaacggcuggaccgacaccgacuccgacuucagcgugaagcaggacgucguggccaucacggacugguccggguacucgggcagcuucgugcagcaccccgagcucaccggccuggacugcauccgccccugcuucugggucgagcuggugcgggggcucccgaaggagaacaccaccaucuggacguccggcucguccaucagcuucugcggggucaacuccgacaccgccaacuggagcuggcccgacggcgccgagcugcccuucaccaucgacaaguga

SEQ ID NO: 28626 - RNA, 1413 nt, Artificial Sequence; identical to SEQ ID NO: 16798
  derived and/or modified CDS sequence (AUadapt) from InfluenzaA__CAD57255__NA

SEQ ID NO: 28627 - RNA, 1413 nt, Artificial Sequence
  derived and/or modified CDS sequence (AUadapt) from InfluenzaA__CAD57256__NA
augaaccccaaccagaagaucaucaccaucggcucgaucuccguggccaucgggaucaucagccugaugcuccagaucggcaacaucaucuccaucugggccucgcacuccauccagaccgggagccagaaccacacgggcaucugcaaccagcgcaucaucaccuacgagaacuccaccugggucaaccacaccuacgugaacaucaacaacacgaacguggucgcggggaaggacaagaccucggugacccuggccggcaacuccagccugugcuccaucucgggcugggccaucuacaccaaggacaacuccauccggaucgggagcaagggcgacguguucgucauccgcgagccguucaucuccugcucgcaccucgagugccggacguucuuccugacccagggggcccugcucaacgacaagcacuccaacggcaccgugaaggaccgcagccccuaccgggcccugauguccugcccccugggggaggcgcccucgccguacaacagcaaguucgaguccguggccuggucggccuccgccugccacgacggcaugggcuggcucaccaucgggaucagcggccccgacaacggggcggucgccgugcugaaguacaacggcaucaucacggagaccaucaaguccuggaagaagcgcauccugcggacccaggagucggagugcgugugcgucaacggcuccugcuucaccaucaugacggacgggcccagcaacggcgccgccuccuaccgcaucuucaagaucgagaaggggcgggugaccaagucgaucgagcucgacgcccccaacuaccacuacgaggagugcuccugcuacccggacaccggcaccgugaugugcgucugccgcgacaacuggcacgggagcaaccggcccuggguguccuucaaccagaaccuggacuaccagaucggcuacaucugcucgggcguguucggggacaacccccgccccaaggacggcgagggguccugcaacccggucacgguggacggcgcggacggggugaagggcuucagcuacaaguacggcaacggggucuggaucggccggaccaaguccaaccgccugcggaagggguucgagaugaucugggaccccaacggcuggaccgacaccgacucggacuucuccgugaagcaggacguggucgccaucacggacuggagcggguacucgggcuccuucgugcagcaccccgagcucaccggccuggacugcauccgccccugcuucugggucgagcuggugcgggggcgcccgcgggagaacaccaccaucuggacgagcggcuccucgaucuccuucugcggggugaacagcgacaccgccaacugguccuggcccgacggcgccgagcuccccuucaccaucgacaaguga

SEQ ID NO: 28628 - RNA, 1413 nt, Artificial Sequence
  derived and/or modified CDS sequence (AUadapt) from InfluenzaA__CAD57257__NA
augaaccccaaccagaagaucaucaccaucggcucgaucuccaucgccaucgggaucaucucgcugaugcuccagaucggcaacaucaucuccaucugggccagccacuccauccagaccgggucgcagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucucgggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccucgaacggcgccgccuccuacaagaucuucaagaucgagaaggggaaggucaccaagagcaucgagcucaacgcccccaacucccacuacgaggagugcucgugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcgaggggucgugcaacccggugacggucgacggcgcggacggggugaagggcuucuccuaccgguacggcaacgggguguggaucggccgcaccaagagcaaccggcugcgcaagggguucgagaugaucugggaccccaacggcuggaccgacaccgacuccgacuucucgaugaagcaggacgucguggccaugacggacuggagcggguacuccggcucguucgugcagcaccccgagcucaccggccuggacugcauccggcccugcuucugggucgagcuggugcgcgggcggccgcgcgagaacaccaccaucuggacguccggcagcuccaucucguucugcggggucaacuccgacaccgccaacuggagcuggcccgacggcgccgagcuccccuucaccaucgacaaguga

SEQ ID NO: 28629 - RNA, 1413 nt, Artificial Sequence
  derived and/or modified CDS sequence (AUadapt) from InfluenzaA__CAD57258__NA
augaaccccaaccagaagaucaucaccaucggcucgaucuccguggccaucgggaucaucagccugauccuccagaucggcaacaucaucuccaucugggccucgcacuccauccagaccgggagccagaacuacacgggcaucugcaaccagcgcaucaucaccuacgagaacuccaccugggucaaccagaccuacgugaacaucaacaacacgaacguggucgcggggaaggacaagaccucgauggugcuggccggcaacuccagccugugcccgauccggggcugggccaucuacaccaaggacaacuccauccgcaucgggucgaagggcgacaucuucgugauccgggagcccuucaucuccugcagccaccucgagugccgcaccuucuuccugacgcagggggcccugcucaacgacaagcacuccaacggcaccgucaaggaccggagccccuaccgcgcccugauguccugcccccugggggaggcgccgucgcccuacaacucccgguucgagagcguggccuggucggccuccgccugccacgacggccucggcuggcugaccaucgggaucagcggccccgacaacggggcgguggccguccugaaguacaacggcaucaucaccgagacgaucaaguccuggaagaagcagauccuccgcacccaggagucggagugcgugugcgugaacggcuccugcuucaccaucaugaccgacgggcccagcaaccgggccgccuccuaccgcaucuucaagaucgagaagggccgggucaccaagucgaucgagcuggacgccccgaacuaccacuacgaggagugcuccugcuaccccgacacggggaccgugaugugcgugugccgcgacaacuggcacggcagcaaccggcccugggucuccuucaaccagaaccuggacuaccagaucggguacaucugcagcggcguguucggcgacaacccccgcccgaaggacggggagggcuccugcaaccccgugaccgucgacggggcggacggcgugaagggguucucguaccgguacggcaacggcguguggaucgggcgcacgaaguccaaccggcuccgcaagggcuucgagaugaucugggaccccaacggguggaccgacaccgacagcgacuucuccaugaagcaggacgucguggccaugaccgacuggucgggcuacuccgggagcuucgugcagcaccccgagcugacgggccuggacugcaugcggccgugcuucugggucgagcucgugcgcggccugccccgggagaacaccaccaucuggaccucgggguccagcaucuccuucugcggcgucaacagcgagacggccaacugguccuggcccgacggggccgagcugcccuucaccaucgacaaguga

SEQ ID NO: 28630 - RNA, 1413 nt, Artificial Sequence
  derived and/or modified CDS sequence (AUadapt) from InfluenzaA__CAD57259__NA
augaaccccaaccagaagaucaucaccaucggcucgaucuccaucgccaucgggaucaucucgcugauccuccagaucggcaacaucaucuccaucugggccagccacuccauccagaccgagucgcagaaccacacggggaucugcaaccagcgcaucaucaccuacgagaacuccaccugggugaaccagaccuacgucaacaucaacaacacgaacguggcggccggcaaggacaagaccagcaugacccuggccgggaacuccucgcugugcccgauccggggcugggccaucuacaccaaggacaacuccauccgcaucggcagcaagggggacaucuucgugauccgggagcccuucaucuccugcucgcaccucgagugccgcacguucuuccugacccagggcgcccugcucaacgacaagcacuccaacgggaccgucaaggaccggucgcccuaccgcgcgcugauguccugcccccugggcgaggccccgagccccuacaacucccgguucgagucgguggccuggagcgccuccgcgugccacgacgggcucggcuggcugaccaucggcaucucggggcccgacaacggcgccguggccguccugaaguacaacgggaucaucacggagaccaucaaguccuggaagaagcgcauccuccggacccaggagagcgagugcgugugcaugaacggcuccugcuucaccaucaugacggacggccccucgaacggggccgccuccuaccgcaucuucaagaucgagaagggccgggugaccaagagcaucgagcuggacgcgccgaacuaccacuacgaggagugcuccugcuaccccgagaccgggaccgucaugugcgugugccgcgacaacuggcacggcucgaaccggcccuggguguccuucaaccagaaccuggacuaccagaucggguacaucugcucgggcgucuucggcgacaacccccgcccgaaggacggggagggcuccugcaaccccgugacgguggacggggccgacggcgucaagggguucagcuaccgguacggcaacggcguguggaucgggcgcaccaaguccaaccggcuccgcaagggcuucgagaugaucugggaccccaacggguggaccgacaccgacucggacuucuccaugaagcaggacaucguggccaugacggacuggagcggcuacuccgggucguucguccagcaccccgagcugaccggccuggacugcaugcggccgugcuucuggguggagcucgugcgcggccugccccgggagaacaccaccaucuggacgagcggguccucgaucuccuucugcggcgucaacagcgacaccgccaacugguccuggcccgacggggccgagcugcccuucaccaucgacaaguga

SEQ ID NO: 28631 - RNA, 1413 nt, Artificial Sequence
  derived and/or modified CDS sequence (AUadapt) from InfluenzaA__CAD57264__NA
augaaccccaaccagaagaucaucaccaucggcucgaucuccguggccaucgggaucaucagccugauccuccagaucggcaacaucaucuccaucugggccucgcacuccauccagaccgggagccagaacuacacgggcaucugcaaccagcgcaucaucaccuacgagaacuccaccugggucaaccagaccuacgugaacaucaacaacacgaacguggucgcggggaaggacaagaccucgaugacccuggccggcaacuccagccugugcccgauccggggcugggccaucuacaccaaggacaacuccauccgcaucgggucgaagggcgacguguucgugauccgggagcccuucaucuccugcagccaccucgagugccgcacguucuuccugacccagggggcccugcucaacgacaagcacuccaacggcaccgucaaggaccggucgcccuaccgcgcccugauguccugcccccugggggaggcgccgagccccuacaacucccgguucgagucgguggccuggagcgccuccgccugccacgacggccucggcuggcugaccaucgggaucucgggccccgacaacggggcgguggccguccugaaguacaacggcaucaucacggagaccaucaaguccuggaagaagcagauccuccgcacccaggagagcgagugcgugugcgugaacggcuccugcuucaccaucaugacggacgggcccucgaacggcgccgccuccuaccggaucuucaagaucgagaaggggcgcgucaccaagagcaucgagcuggacgccccgaacuaccacuacgaggagugcuccugcuaccccgacaccggcaccgugaugugcgugugccgggacaacuggcacgggucgaaccgccccugggucuccuucaaccagaaccuggacuaccagaucggcuacaucugcagcggcguguucggggacaacccccggccgaaggacggcgagggguccugcaaccccgugacggucgacggcgcgaacggggugaagggcuucucguaccgcuacggcaacgggguguggaucggccggaccaaguccaaccgccuccggaagggguucgagaugaucugggaccccaacggcuggaccgacaccgacagcgacuucuccaugaagcaggacgucguggccaugacggacuggucgggguacuccggcagcuucgugcagcaccccgagcugaccggccuggacugcaugcgcccgugcuucugggucgagcucgugcgggggcugccccgcgagaacaccaccaucuggacgucgggcuccagcaucuccuucugcggggucaacagcgagaccgccaacugguccuggcccgacggcgccgagcugcccuucaccaucgacaaguga

SEQ ID NO: 28632 - RNA, 1350 nt, Artificial Sequence
  derived and/or modified CDS sequence (AUadapt) from InfluenzaA__CBW54819__NA
augaaucccaaccaaaagaucaucaccaucggcagcaucugcauggugaucgggaucgucucccugaugcuccagaucggcaacaugaucagcaucugggugucccacagcauccagaccgggaaccagugucaagccgagccgaucuccaacacgaaguuccugaccgagaaggccguggcgagcgucacccuggccggcaacuccagccucugccccaucuccgggugggccguguacagcaaggacaauuccauccgcaucggcagccggggcgacguguucgucauccgcgaacccuucaucuccugcagccaccuggagugccggaccuuuuuccugacgcagggggcccuccugaacgacaagcacuccaacggcaccgugaaggaccgcagcccccaccggacccugauguccugcccggugggggaagcccccagucccuacaacucccgcuucgagagcgucgcguggagcgccuccgccugccacgacggcaucaguuggcucaccaucgggaucuccggccccgacaacggcgccguggcggugcugaaguacaacgggaucaucacggacaccaucaagagcuggcggaacaacauccugcgcacccaggaguccgaaugcgccugugucaacggcagcugcuucaccgugaugacggacgggccguccagcggccaggccuccuacaagaucuucaagauggagaaaggcaagguggucaagagcguggagcucgaugcccccaacuaccacuacgaggagugcuccugcuaccccgacgccggggaaaucacgugugugugccgggacaacuggcacggcagcaaccgccccugggucuccuucaaccagaaccuggaguaucggaucggguacaucugcagcggcguguucggggacaacccgcgccccaacgacggcaccggcuccugugggcccgugagccccaacggcgcguacggggucaagggcuucuccuucaaguacggggacggcguguggaucggccggaccaaaagcaccaacucccgcaguggguucgagauggugugggacccgaacggcuggaccgggaccgacagcuccuucagcgucaagcaggacaucguggccaucaccgauugguccggcuacagcggguccuucguccagcaccccgagcugacgggccucgacugcauccggcccugcuucuggguggaacugauccgcggccggcccaaggagagcaccaucuggaccuccgggaguuccaucagcuucugcggcgugaacuccgacaccgucagcugguccuggccggacggggccgagcugcccuucacgaucgacaaguga

SEQ ID NO: 28633 - RNA, 1350 nt, Artificial Sequence
  derived and/or modified CDS sequence (AUadapt) from InfluenzaA__CBW54821__NA
augaaucccaaccaaaagaucaucaccaucggcagcaucugcaucgugaucgggaucgucucccugaugcuccagaucggcaacaugaucagcaucugggugucccacagcauccagaccgggaaccagugucaggccgagccgaucuccaacacgaaguuccugaccgagaaggccguggcgagcgucacccuggccggcaacuccagccucugccccaucuccgggugggccguguacagcaaggacaauuccauccgcaucggcagccggggcgacguguucgucauccgcgagcccuucaucuccugcagccaccuggagugccggaccuuuuuccugacgcaaggggcccuccugaacgacaagcacuccaacggcaccgugaaggaccgcagcccccaccggacccugauguccugcccggugggggaggcccccagucccuacaacucccgcuucgagagcgucgcguggagcgccuccgccugccacgacggcaucaguuggcucaccaucgggaucuccggccccgacaacggcgccguggcggugcugaaguacaacgggaucaucacggacaccaucaagagcuggcggaacaacauccugcgcacccaggaguccgagugcgccuguaucaacggcagcugcuucaccgucaugacggacgggccguccagcggccaggccuccuacaagaucuucaagauggaaaagggcaagguggucaagagcguggagcucgaugcccccaacuaccacuacgaggagugcuccugcuaccccgacgccggggagaucacgugugugugccgggacaacuggcacggcagcaaccgccccuggguguccuucaaccagaaccuggaguaucagaucggguacaucugcagcggcgucuucggggacaacccgcggcccaacgacggcaccggcuccugugggcccgugagccccaacggcgcguacggggugaagggcuucuccuucaaguacgggaacggcgucuggaucggccgcaccaaaagcaccaacucccggaguggguucgagaugaucugggacccgaacggcuggaccgggaccgacagcuccuucagcgugaagcaggacaucguggccaucaccgauugguccggcuacagcggguccuucguccagcaccccgagcugacgggccucgacugcauccgccccugcuucuggguggagcugauccggggccagcccaaggagagcaccaucuggaccuccgggaguuccaucagcuucugcggcgucaacuccgacaccgugagcugguccuggccggacggggccgagcugcccuucacgaucgacaaguga

SEQ ID NO: 28634 - RNA, 1410 nt, Artificial Sequence
  derived and/or modified CDS sequence (AUadapt) from InfluenzaA__CCG47912__NA
augaaccccaaccagaagaucaucaccaucggcucggugucccugaccaucgccacgaugugccucuucaugcagaucgccauccugaucaccaccgucacccugcacuucaagcaguacgagugcgacagcccggcgaacaaccaggugaugcccugcgagcccaucaucaucgagaagaacaucacgaagaucguguaccucaccaacaccaccaucgagaaggaggucugccccaagcugggggaguaccgcaacugguccaagccgcagugccggaucacgggcuucgcccccuucucgaaggacaacuccauccgccugagcgccgggggcgccaucugggugacccgggagcccuacguguccugcgaccccaacaagugcuaccaguucgcccucgggcagggcaccacccuggacaaccgccacucgaacgacacgauccacgaccggaccccguaccgcacccugcucaugaacgagcugggcguccccuuccaccuggggacccgccaggugugcaucgcgugguccagcuccucgugccacgacggcaaggccuggcuccacgugugcgucacggggcacgacaagaacgccaccgccuccuucaucuacgacggcaagcugguggacagcaucuccucguggucccagaacauccugcggacccaggagagcgagugcgugugcaucaacgggaucugcaccgucgugaugacggacggcuccgcgucgggcaaggccgacaccaagauccucuucaucgaggaggggaaggugauccacaucagcccccugcugggcuccgcccagcacgucgaggagugcucgugcuacccccgguacccggacgugcgcugcaucugccgggacaacuggaagggguccaaccgccccaucguggacauccggaugaaggacuacagcaucggcuccucguacaugugcuccggccucgucggggacacgccccgcaacaacgacggcagcuccaacucgaacugccggaaccccaacaacgagcgcgggaaccacggcgugaaggggugggccuucgacgacggcaacgacaucuggaugggccggaccaucuccaaggacagccgccugggguacgagaccuucaagguggucggcggguggucccagccgaacucgaaguuccagaucaaccgccaggugaucguggacuccgacaaccggagcggcuacuccgggaucuucucggucgagggcaaguccugcaucaaccggugcuucuacguggagcugauccgcggccgccggcaggagacccgcgucugguggaccagcaacucgaucgugguguucugcgggaccuccggcacguacgggagcggcuccuggcccgacggggccgacaucaacuucaugcccaucuga

SEQ ID NO: 28635 - RNA, 1353 nt, Artificial Sequence
  derived and/or modified CDS sequence (AUadapt) from InfluenzaA__AAF74321__NA
augaaucccaaccagaagaucaucaccaucggcagcaucugcaugguggucgggaucaucucccugaugcuccagaucggcaacaucaucagcgugugggugucccacaccauccagacguggcacccgaaccagcccgagcccugcaaucagagcaucaacuucuacaccgagcaggccgccgcguccgucacccuggccgggaacagcucccugugccccaucagcggcugggccaucuacuccaaggauaacagcauccgcaucggguccaagggcgacguguucgugauccgggagccguucaucagcugcucccaccucgagugccgcaccuucuuucugacgcagggcgcccugcucaacgacaagcacagcaacgggaccgucaaggaccggucccccuaccgcacccugaugagcugccccgugggcgaggcccccuccccguauaacagccgguucgaguccguggcguggagcgccagcgccugccacgacgggaucuccuggcugaccaucggcaucagcgggcccgauaacggcgccgucgcggugcucaaguacaacggcaucaucacggacaccaucaaguccuggcgcaacaacauccugcggacccaggagagcgagugcgccugcgugaacggguccuguuucaccgucaugacggacggccccagcaacgagcaggccuccuacaagaucuucaagaucgagaaggggcgcguggugaaguccgucgagcugaacgcccccaacuaccauuaccaggagugcuccugcuacccggacgccggcgagaucacgugcgugugccgggacaacuggcacggcaguaaccgccccuggguguccuucaaccagaaccucgaguaccagaucggguacaucugcagcggcgucuucggggauagcccccggcccaacgacggcaccgggagcugcggcccggugucccugaacggcgcguacggggugaagggcuucagcuuuaaguacgggaacggcgucuggaucgggcgcaccaaguccaccagcucccggagcggcuucgagaugaucugggaccccaacggcuggaccgagaccgacagcuccuucagucugaagcaggacaucaucgccaucaccgacugguccggguacagcggcuccuucauccagcaccccgagcucacggggcugaacugcaugcgccccugcuuuuggguggagcugauccggggccgcccgaaggagaagaccaucuggaccagcggguccagcaucuccuucugcggcgugaacagcgacaccgucggcugguccuggcccgacggggccgagcuccccuucacgaucgacaaguga

SEQ ID NO: 28636 - RNA, 1353 nt, Artificial Sequence
  derived and/or modified CDS sequence (AUadapt) from InfluenzaA__AAF74322__NA
augaaucccaaccagaagaucaucaccaucggcucgaucugcaugguggucgggaucaucucccugaugcuccagaucggcaacaccaucagcgugugggugucccacaucaucaagacguggcacccgaaccagcccgagcccugcaaucagagcaucaacuucuacaccgagcaggccgccgcguccgucacccuggccgggaacagcucccugugccccaucagcggcugggccaucuacuccaaggauaacagcauccgcaucggguccaagggcgacguguucgugauccgggagccguucaucagcugcucccaccucgagugccgcaccuucuuucugacgcagggcgcccugcucaacgacaagcacagcaacgggaccgucaaggaccggucccccuaccgcacccugaugagcugccccgugggcgaggcccccuccccguauaacagccgguucgaguccguggcguggagcgccagcgccugccacgacgggaucuccuggcugaccaucggcaucagcgggcccgauaacggcgccgucgcggugcucaaguacaacggcaucaucacggacaccaucaaguccuggcgcaacaacacccugcggacccaggagagcgagugcgccugcgugaacggguccuguuucacggucaugaccgacggccccagcaacgagcaggccuccuacaagaucuucaagaucgagaaggggcgcguggugaaguccgucgagcugaacgcccccaacuaccauuacgaggagugcuccugcuacccggacgccggcgagaucacgugcgugugccgggacaacuggcacggcaguaaccgccccuggguguccuucaaccagaaccucgaguaccagaucggguacaucugcagcggcgucuucggggauagcccccggcccaacgacggcaccgggagcugcggcccggugucccugaacggcgcguacggggugaagggcuucagcuuuaaguacgggaacggcgucuggaucgggcgcaccaaguccaccagcucccggagcggcuucgagaugaucugggaccccaacggcuggaccgagaccgacagcuccuucagucugaagcaggacaucaucgccaucacggacugguccggguacagcggcuccuucauccagcaccccgagcucaccgggcugaacugcaugcgccccugcuuuuggguggagcugauccggggccgcccgaaggagaagaccaucuggaccagcggguccagcaucuccuucugcggcgugaacagcgacacggucggcugguccuggcccgacggggccgagcuccccuucaccaucgacaaguga

SEQ ID NO: 28637 - RNA, 1353 nt, Artificial Sequence
  derived and/or modified CDS sequence (AUadapt) from InfluenzaA__AAF74323__NA
augaaucccaaccaaaagaucaucaccaucggcagcaucugcaugguggucgggaucaucucccugaugcuccagaucggcaacaucaucagcguguggaucucccacaucauccagaccuggcacccgaaccagcccgagcccugcaaccagaguaucaacuucuacacggagcaggccgccgcguccgugacccuggccgggaacagcucccugugccccaucagcggcugggccaucuacuccaaggacaacaguauccgcaucggguccaagggcgacgucuucgugauccgggagccguucaucagcugcucccaccucgagugccgcaccuucuuccugacccagggcgcccugcucaacgauaagcacagcaacgggacggugaaggaccggucccccuaccgcacccugaugagcugccccgucggcgaggcccccuccccguacaacagccgguucgaguccguggcguggagugccagcgccugccacgacgggaucuccuggcugaccaucggcaucagcgggcccgacaacgaggccguggcgguccucaaguacaacggcaucaucaccgacacgauccgcuccuggcggaauaacauccugcgcacccaggagagcgagugcgccugcgugaacggcuccugcuucaccgugaugaccgacgggcccagcaacgagcaggccuccuauaagaucuucaagaucgagaagggccgggucgugaaguccguggagcugaacgcccccaacuaccacuacgaggagugcuccugcuacccggacgccggggagaucacgugugucugccgcgacaacuggcacggcagcaaccggcccuggguguccuucaaccagaaccucgaguaccagaucggcuacaucuguagcgggguguucggcgacagcccccgccccaacgacgggaccggcagcugcgggccggucucccugaacggcgcguacggcgugaagggguuuagcuucaaguacggcaacgggguguggaucggccggaccaaguccaccagcucccgcagcggguucgagaugaucugggaccccaacggcuggacggagaccgacaguuccuucagccugaagcaggacaucaucgccgucaccgacugguccggcuacagcggguccuucauccagcaccccgagcucaccggccugaacugcaugcggcccuguuucuggguggagcugauccgcgggcggccgaaggagaagacgaucuggaccagcggcuccagcaucuccuucugcggggugaacagcgacaccgucggcugguccuggcccgacggcgccgagcuccccuucaccaucgacaaguga

SEQ ID NO: 28638 - RNA, 1353 nt, Artificial Sequence
  derived and/or modified CDS sequence (AUadapt) from InfluenzaA__AAF74324__NA
augaaucccaaccagaagaucaucaccaucggcagcaucugcaugguggucgggaucaucucccugaugcuccagaucggcaacaucaucagcgugugggugucccacaucauccagaccuggcacccgaaccagcccgagcccugcaaccagaguaucaacuucuacacggagcaggccgccgcguccgucacccuggccgggaacagcucccugugccccaucagcggcugggccaucuacuccaaggacaacaguauccgcaucggguccaagggcgacguguucgugauccgggagccguucaucagcugcucccaccucgagugccgcaccuucuuccugacccagggcgcccugcucaacgauaagcacagcaacgggacggucaaggaccggucccccuaccgcacccugaugagcugccccgugggcgaggcccccuccccguacaacagccgguucgaguccguggcguggagugccagcgccugccacgacgggaucuccuggcugaccaucggcaucagcgggcccgacaacggcgccgucgcggugcucaaguacaacggcaucaucaccgacacgaucaaguccuggcgcaauaacauccugcggacccaggagagcgagugcgccugcgugaacggguccugcuucaccgucaugaccgacggccccagcaacgagcaggccuccuauaagaucuucaagaucgagaaggggcgcguggugaaguccgucgagcugaacgcccccaacuaccacuacgaggagugcuccugcuacccggacgccggcgagaucacgugugugugccgggacaacuggcacggcagcaaccgccccuggguguccuucaaccagaaccucgaguaccagaucggguacaucuguagcggcgucuucggggacagcccccggcccaacgacggcaccgggagcugcggcccggugucccugaacggcgcguacggggugaagggcuuuagcuucaaguacgggaacggcgucuggaucgggcgcaccaaguccaccagcucccggagcggcuucgagaugaucugggaccccaacggcuggacggagaccgacaguuccuucagccugaagcaggacaucaucgccaucaccgacugguccggguacagcggcuccuucauccagcaccccgagcucaccgggcugaacugcaugcgccccuguuucuggguggagcugauccggggccgcccgaaggagaagacgaucuggaccagcggguccagcguguccuucugcggcgucaacagcgacaccaugggcugguccuggcccgacggggccgagcuccccuucaccaucgacaaguga

SEQ ID NO: 28639 - RNA, 1353 nt, Artificial Sequence
  derived and/or modified CDS sequence (AUadapt) from InfluenzaA__AAF74325__NA
augaaucccaaccagaagaucaucaccaucggcucgaucugcaugguggucgggaucaucucccugaugcuccagaucggcaacaccaucagcgugugggugucccacaucaucaagacguggcacccgaaccagcccgagcccugcaaucagagcaucaacuucuacaccgagcaggccgccgcguccgucacccuggccgggaacagcucccugugccccaucagcggcugggccaucuacuccaaggauaacagcauccgcaucggguccaagggcgacguguucgugauccgggagccguucaucagcugcucccaccucgagugccgcaccuucuuucugacgcagggcgcccugcucaacgacaagcacagcaacgggaccgucaaggaccggucccccuaccgcacccugaugagcugccccgugggcgaggcccccuccccguauaacagccgguucgaguccguggcguggagcgccagcgccugccacgacgggaucuccuggcugaccaucggcaucagcgggcccgauaacggcgccgucgcggugcucaaguacaacggcaucaucacggacaccaucaaguccuggcgcaacaacacccugcggacccaggagagcgagugcgccugcgugaacggguccuguuucacggucaugaccgacggccccucgaacgagcaggccuccuacaagaucuucaagaucgagaaggggcgcguggugaaguccgucgagcugaacgcccccaacuaccauuacgaggagugcuccugcuacccggacgccggcgagaucacgugcgugugccgggacaacuggcacggcaguaaccgccccuggguguccuucaaccagaaccucgaguaccagaucggguacaucugcagcggcgucuucggggauagcccccggcccaacgacggcaccgggagcugcggcccggugucccugaacggcgcguacggggugaagggcuucagcuuuaaguacgggaacggcgucuggaucgggcgcaccaaguccaccagcucccggagcggcuucgagaugaucugggaccccaacggcuggaccgagaccgacagcuccuucagucugaagcaggacaucaucgccaucacggacugguccggguacagcggcuccuucauccagcaccccgagcucaccgggcugaacugcaugcgccccugcuuuuggguggagcugauccggggccgcccgaaggagaagaccaucuggaccagcggguccagcaucuccuucugcggcgugaacagcgacacggucggcugguccuggcccgacggggccgagcuccccuacaccaucgacaaguga

SEQ ID NO: 28640 - RNA, 1401 nt, Artificial Sequence
  derived and/or modified CDS sequence (AUadapt) from InfluenzaB__EPI173278__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccgcuccgccaccaagggcgucacccuccugcugcccgagccggaguggaccuacccccggcucagcugccccggguccacguuccagaaggcccugcugaucagcccccaucgcuucggcgagaccaaggggaacuccgcgccgcucaucauccgggagcccuucaucgccugcggccccaacgagugcaagcacuuugcccugacccacuacgccgcgcagcccggcggguacuacaacggcacccgcggggaccggaauaagcugcgccaccucaucucggugaagcugggcaagaucccgacgguggagaacuccaucuuccacauggccgccuggagcggguccgccugucacgacggcaaggaguggaccuacaucggcgucgacgggcccgacaacaacgcccugcucaaggugaaguauggcgaggcguacaccgacaccuaccacagcuacgccaauaagauccugcggacgcaggaguccgccugcaacugcaucgggggcaacugcuaccugaugaucaccgauggcagcgccucggggguguccgagugccgcuuccucaagauccgggagggccgcaucaucaaggagaucuuccccaccgggcgggucaagcacaccgaggaguguacgugcggcuucgccagcaacaagaccaucgagugcgcgugccgcgacaauuccuacaccgccaagcggcccuucgugaagcugaacguggagaccgacacggccgagauccgccugaugugcaccgacaccuaucucgacaccccgcggcccaacgacgggagcaucacgggccccugcgaguccaacggcgauaaggggagcggcgggaucaagggcggguucguccaccagcgcauggaguccaagaucggccggugguacucgcgcaccauguccaagaccgagcggaugggcauggggcuguacgugaaguacgauggcgaccccugggccgacagcgacgcccuggcguucuccggggugauggucagcaugaaggagccgggcugguauuccuucggguucgagaucaaggacaagaagugcgacgugcccugcaucggcaucgagauggugcaugacggcgggaaggagaccuggcacagcgccgccacggccaucuacugccucaugggcuccgggcagcugcugugggacaccgucaccggcguggacauggcccucuga

SEQ ID NO: 28641 - RNA, 1401 nt, Artificial Sequence; identical to SEQ ID NO: 28640
  derived and/or modified CDS sequence (AUadapt) from InfluenzaB__EPI498049__NA

SEQ ID NO: 28642 - RNA, 1401 nt, Artificial Sequence; identical to SEQ ID NO: 28640
  derived and/or modified CDS sequence (AUadapt) from InfluenzaB__AFH57913__NA

SEQ ID NO: 28643 - RNA, 1401 nt, Artificial Sequence; identical to SEQ ID NO: 28640
  derived and/or modified CDS sequence (AUadapt) from InfluenzaB__EPI827074__NA

SEQ ID NO: 28644 - RNA, 1401 nt, Artificial Sequence; identical to SEQ ID NO: 28640
  derived and/or modified CDS sequence (AUadapt) from InfluenzaB__EPI244698__NA

SEQ ID NO: 28645 - RNA, 1401 nt, Artificial Sequence; identical to SEQ ID NO: 28640
  derived and/or modified CDS sequence (AUadapt) from InfluenzaB__EPI244701__NA

SEQ ID NO: 28646 - RNA, 1401 nt, Artificial Sequence
  derived and/or modified CDS sequence (AUadapt) from InfluenzaB__EPI540672__NA
augcugcccaguaccauccagacccucacgcuguuccugaccuccggcggggugcuccugagccuguacgucuccgccagccucuccuaucugcuguacagcgacauccuccugaaguucucccgcaccgaggugaccgccccgaucaugccccuggacugugcgaacgccagcaacgugcaggccgucaaccgguccgccacgaagggcgugacgccccuccugcccgagccggaguggaccuacccccgccugaguugccccggguccaccuuccagaaggcccuccugaucucgccccaccgguucggcgagaccaaggggaauuccgcgccgcugaucauccgcgagcccuucaucgccugcggccccaaggagugcaagcacuucgcccucacccauuacgccgcgcagcccggcggguacuacaacggcacccgggaggaccgcaauaagcugcggcaccugaucagcgugaagcucgggaagaucccgaccgucgagaacuccaucuuccacauggccgccuggaguggcuccgccugccacgacgggcgcgaguggacguacaucggcguggacggccccgauagcaacgcccugcugaagaucaaguacggggaggcguacaccgacaccuaucacuccuacgccaagaacauccuccggacccaggagagcgccugcaauugcaucggcggggacugcuaccugaugaucacggacggccccgccaguggcaucuccgagugccgcuuccugaagauccgggaggggcgcaucaucaaggagaucuuccccaccggccgggugaagcacaccgaggagugcacguguggguucgccucgaacaagaccaucgagugcgcgugccgcgauaacuccuacaccgccaagcggccguucgucaagcucaacguggagaccgacaccgccgagauccgccugauguguacgaagaccuaccuggacacgccccggcccaacgacggcagcaucaccgggcccugugaguccgacggcgacgagggcagcgggggcaucaagggcggguucgugcaccagcgcauggccuccaagaucgggcggugguauagccgcaccauguccaagaccaagcggaugggcaugggccucuacgucaaguacgacggggacccguggaccgauagcgaggcccuggcgcuguccggcgugauggugagcauggaggagcccgggugguacuccuucggcuucgagaucaaggauaagaagugcgacguccccugcaucgggaucgagauggugcacgacggcggcaagaccacguggcauagcgccgccaccgccaucuacugccucaugggguccggccagcugcugugggacaccgugaccggggucaacaugacgcucuga

SEQ ID NO: 28647 - RNA, 1401 nt, Artificial Sequence; identical to SEQ ID NO: 28646
  derived and/or modified CDS sequence (AUadapt) from InfluenzaB__EPI829465__NA

SEQ ID NO: 28648 - RNA, 1401 nt, Artificial Sequence
  derived and/or modified CDS sequence (AUadapt) from InfluenzaB__EPI684428__NA
augcugcccaguaccauccagacccucacgcuguuccugaccuccggcggggugcuccugagccuguacgucuccgccagccucuccuaucugcuguacagcgacauccuccugaaguucucccgcaccgaggugaccgccccgacgaugccccuggacugugcgaacgccagcaacgugcaggccgucaaccgguccaccaccaagggcgugacgccccucuuccccgagccggaguggaccuauccccgccugagcugccccggguccaccuuccagaaggcccugcucaucucgccccaucgguucggcgagaccaaggggaacuccgccccgcugaucauccgcgagcccuucaucgcgugcggccccaaggagugcaagcauuucgcccugacccacuacgccgcccagcccggcggguacuacaauggcacgcgggaggaccgcaacaagcuccggcaccugaucagcgugaagcuggggaagaucccgaccgucgagaacuccaucuuucacauggcggccuggagcggcuccgccugccacgaugggcgcgaguggaccuacaucggcguggacggccccgacagcaacgcccuccugaagaucaaguauggggaggccuacaccgacacguaccacuccuacgcgaagaauauccugcggacccaggagagcgccugcaacugcaucggcggggauugcuaccucaugaucaccgacggccccgccagcggcguguccgagugccgcuuucugaagauccgggaggggcgcaucaucaaggagaucuuccccaccggccgggucaagcacacggaggagugcacgugcggguucgccaguaacaagaccaucgagugcgccugccgcgacaaccgguauaccgcgaagcgcccguucgugaagcugaacguggagaccgacaccgccgagauccggcucaugugcaccaagaccuaucuggacacgccccgccccaacgacggcuccaucaccgggcccugcgagagcgauggcgacgagggcuccgggggcaucaagggcggguucguccaccagcggauggccagcaagaucgggcgcugguacucccggaccaugaguaagaccaagcgcaugggcaugggccuguacgugaaguacgacggggacccguggacggauuccgaggcccucgcccugagcggcgugauggucuccauggaggagcccgggugguacagcuucggcuucgagaucaaggauaagaagugcgacgugcccugcaucgggaucgagauggugcacgacggcggcaagaccaccuggcauuccgcggccaccgccaucuacugccugauggggagcggccagcuccugugggacacggucaccggggugaacaugacccuguga

SEQ ID NO: 28649 - RNA, 1401 nt, Artificial Sequence
  derived and/or modified CDS sequence (AUadapt) from InfluenzaB__AFH58451__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccucgaaugugcaggccgugaaccgcuccgccaccaagggcgucaccuuccuccugcccgagccggaguggaccuacccccggcugagcugccccggguccacguuccagaaggcccuccugaucagcccccaucgcuucggcgagaccaaggggaacuccgcgccgcugaucauccgggagcccuucaucgccugcggccccaacgagugcaagcauuucgcccucacccacuacgccgcgcagcccggcggguacuacaacggcacccgcggggaucggaacaagcugcgccaccugaucagcgugaagcucggcaagaucccgacgguggagaacuccaucuuccacauggccgccuggagcggguccgccugucacgacggcaaggaguggaccuacaucggcgucgacgggcccgacaacaaugcccugcugaaggugaaguacggcgaggcguacaccgacaccuaccacucguaugccaacaagauccuccggacgcaggaguccgccugcaacugcaucgggggcaacugcuaccugaugaucaccgauggcagcgccagcgggguguccgagugccgcuuccugaagauccgggagggccgcaucaucaaggagaucuuccccaccgggcgggucaagcacaccgaggaguguacgugcggcuucgccagcaacaagaccaucgagugcgcgugccgcgauaacuccuacaccgccaagcggcccuucgugaagcucaacguggagaccgacacggccgagauccgccugaugugcaccgacaccuaucuggacaccccgcggcccgacgacgggagcaucacgggccccugcgaguccaacggcgaugaggggucgggcgggaucaagggcggguucguccaccagcgcauggaguccaagaucggccggugguacagccgcaccauguccaagaccgagcggaugggcauggggcucuacgugaaguaugacggcgaccccugggccgacagcgacgcccuggcguucuccggggugauggucagcaugaaggagccgggcugguauuccuucggguucgagaucaaggacaagaagugcgacgugcccugcaucggcaucgagauggugcaugacggcgggaaggagaccuggcacagcgccgccacggccaucuacugccugaugggcuccgggcagcuccugugggacaccgucaccggcguggacaugacccuguga

SEQ ID NO: 28650 - RNA, 1401 nt, Artificial Sequence; identical to SEQ ID NO: 28640
  derived and/or modified CDS sequence (AUadapt) from InfluenzaB__EPI173280__NA

SEQ ID NO: 28651 - RNA, 1401 nt, Artificial Sequence; identical to SEQ ID NO: 28640
  derived and/or modified CDS sequence (AUadapt) from InfluenzaB__EPI186302__NA

SEQ ID NO: 28652 - RNA, 1401 nt, Artificial Sequence
  derived and/or modified CDS sequence (AUadapt) from InfluenzaB__EPI636339__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccagcaacgugcaggccgugaaccgcuccgccaccaagggcgucacccuccugcugcccgagccggaguggaccuacccccggcucagcugucccggguccacguuccagaaggcccugcugaucucgccccaccgcuucggcgagaccaaggggaacuccgcgccgcucaucauccgggagcccuuuguggccugcggccccaacgagugcaagcacuucgcccugacccacuaugccgcgcagcccggcggguacuacaacggcacccgcggggaccggaacaagcugcgccaucucaucagcgugaagcugggcaagaucccgacggucgagaacuccaucuuccacauggccgccuggagcggguccgccugucacgacggcaaggaguggaccuacaucggcguggacgggcccgacaauaacgcccugcucaaggugaaguacggcgaggcguacaccgacaccuaccauagcuacgccaacaacauccugcggacgcaggaguccgccugcaacuguaucgggggcaacugcuaccugaugaucaccgacggcagcgccaguggggucuccgagugccgcuuccucaagauccgggagggccgcaucaucaaggagaucuuccccaccgggcgggugaagcacaccgaggagugcacguguggcuucgccucgaacaagaccaucgagugcgcgugccgcgauaaccgguacaccgccaagcgccccuucgugaagcugaacgucgagaccgacacggccgagauccggcugauguguaccgacaccuaccucgacaccccgcgccccaacgacggguccaucacgggccccugcgagagugacggcgacaagggguccggcgggaucaagggcggguucgugcaccagcggaugaaguccaagaucggccgcugguacagucggaccaugagcaagaccgagcgcaugggcauggggcuguacgugaaguacggcggggaccccugggccgacuccgaugcccuggcguucagcggcgucaugguguccaugaaggagccggggugguacagcuucggcuuugagaucaaggacaagaagugcgacgugcccugcaucggcaucgagaugguccacgaugggggcaaggagaccuggcacuccgccgccacggccaucuacugccucauggggagcggccagcugcugugggacaccgugaccggcguggacauggcccucuga

SEQ ID NO: 28653 - RNA, 1401 nt, Artificial Sequence; identical to SEQ ID NO: 28652
  derived and/or modified CDS sequence (AUadapt) from InfluenzaB__EPI645996__NA

SEQ ID NO: 28654 - RNA, 1401 nt, Artificial Sequence
  derived and/or modified CDS sequence (AUadapt) from InfluenzaB__EPI539770__NA
augcugcccaguaccauccagacccucacgcuguuccugaccuccggcggggugcuccugagccuguacgucuccgccagccucuccuaucugcuguacagcgacauccuccugaaguucucccgcaccgaggugaccgccccgaucaugccccuggacugugcgaacgccucgaacgcccaggccgugaaccgguccgccacgaagggcgucacgccccuccugcccgagccggaguggaccuacccccgccugaguugccccggguccaccuuccagaaggcgcuccugaucagcccccaccgguucggcgagaccaaggggaauuccgccccgcugaucauccgcgagcccuucaucgccugcggccccaaggagugcaagcacuucgcccucacccauuacgcggcccagcccggcggguacuacaacggcacccgggaggaccgcaauaagcugcggcaccugaucagcgugaagcucgggaagaucccgaccguggagaacuccaucuuccacauggccgccuggaguggcuccgccugccacgacgggcgcgaguggacguacaucggcgucgacggccccgauucgaacgcgcugcugaagaucaaguacggggaggccuacaccgacaccuaucacuccuacgccaagaacauccuccggacccaggagagcgccugcaauugcaucggcggggacugcuaccugaugaucacggacggccccgccaguggcaucuccgagugccgcuuccugaagauccgggaggggcgcaucaucaaggagaucuuccccaccggccgggugaagcacaccgaggagugcacguguggguucgcgagcaacaagaccaucgagugcgccugccgcgauaacuccuacaccgccaagcggccguucgugaagcucaacgucgagaccgacaccgccgagauccgccugauguguacgaagaccuaccuggacacgccccggcccaacgacggcagcaucaccgggcccugugaguccgacggcgacgagggcucggggggcaucaagggcggguucgugcaccagcgcauggccuccaagaucgggcggugguauagccgcaccauguccaagaccaagcggaugggcaugggccucuacgugaaguacgacggggacccguggaccgauagcgaggcgcuggcccuguccggcgucauggugagcauggaggagcccgggugguacuccuucggcuucgagaucaaggauaagaagugcgacgugcccugcaucgggaucgagaugguccacgacggcggcaagaccacguggcauagcgccgccaccaccaucuacugccucaugggguccggccagcugcugugggacaccgugacgggggugaacaucacccucuga

SEQ ID NO: 28655 - RNA, 1401 nt, Artificial Sequence; identical to SEQ ID NO: 28654
  derived and/or modified CDS sequence (AUadapt) from InfluenzaB__EPI551248__NA

SEQ ID NO: 28656 - RNA, 1401 nt, Artificial Sequence; identical to SEQ ID NO: 28654
  derived and/or modified CDS sequence (AUadapt) from InfluenzaB__EPI544258__NA

SEQ ID NO: 28657 - RNA, 1401 nt, Artificial Sequence; identical to SEQ ID NO: 28646
  derived and/or modified CDS sequence (AUadapt) from InfluenzaB__EPI592698__NA

SEQ ID NO: 28658 - RNA, 1401 nt, Artificial Sequence; identical to SEQ ID NO: 28646
  derived and/or modified CDS sequence (AUadapt) from InfluenzaB__EPI592706__NA

SEQ ID NO: 28659 - RNA, 1401 nt, Artificial Sequence
  derived and/or modified CDS sequence (AUadapt) from InfluenzaB__EPI693093__NA
augcugcccaguaccauccagacccucacgcuguuccugaccuccggcggggugcuccugagccuguacgucuccgccagccucuccuaccugcuguauagcgacauccuccugaaguucucccgcaccgaggugaccgccccgaucaugccccuggacugcgcgaaugccucgaacgugcaggccgucaaccgguccgccacgaagggcgugacgccccuccugcccgagccggaguggaccuacccccgccugagcugucccggguccaccuuccagaaggcccuccugaucagcccccaccgguucggcgagaccaaggggaacuccgcgccgcugaucauccgcgagcccuucaucgccuguggccccaaggagugcaagcacuucgcccucacccacuacgccgcgcagcccggcggguauuacaacggcacccgggaggaccgcaacaagcugcggcaccugaucagugugaagcucgggaagaucccgaccgucgagaacuccaucuuccacauggccgccuggagcggcuccgccugccaugacgggcgcgaguggacguacaucggcguggacggccccgacucgaacgcccugcugaagaucaaguauggggaggcguacaccgacaccuaccacuccuacgccaagaauauccuccggacccaggagagcgccugcaacugcaucggcggggacuguuaccugaugaucacggacggccccgccagcggcaucuccgagugccgcuuccugaagauccgggaggggcgcaucaucaaggagaucuuucccaccggccgggugaagcacaccgaggagugcacgugcggguucgccagcaacaagaccaucgagugugcgugccgcgacaacuccuacaccgccaagcggccguucgucaagcucaauguggagaccgacaccgccgagauccgccugaugugcacgaagaccuaccuggacacgccccggcccaacgauggcagcaucaccgggcccugcgaguccgacggcgacgagggcucggggggcaucaagggcggguuugugcaccagcgcauggaguccaagaucgggcggugguacagccgcaccauguccaagaccaagcggaugggcaugggccucuacgucaaguacgacggggauccguggaccgacagcgaggcccuggcccuguccggcgugauggugagcauggaggagcccgggugguacuccuucggcuuugagaucaaggacaagaagugcgacguccccugcaucgggaucgagauggugcacgauggcggcaagaccacguggcacagcgcggccaccgccaucuacugccucaugggguccggccagcugcugugggacaccgugaccggggucaacaugacgcucuga

SEQ ID NO: 28660 - RNA, 1401 nt, Artificial Sequence
  derived and/or modified CDS sequence (AUadapt) from InfluenzaB__EPI678795__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccgcuccgccaccaagggcgucaccuuccuccugcccgagccggaguggaccuacccccggcugagcugccccggguccacguuccagaaggcccuccugaucagcccccaucgcuucggcgagaccaaggggaacuccgcgccgcugaucauccgggagcccuucguggccugcggccccaacgagugcaagcauuucgcccucacccacuacgccgcgcagcccggcggguacuacaacggcacccgcggggaucggaacaagcugcgccaccugaucucggugaagcucggcaagaucccgacggucgagaacuccaucuuccacauggccgccuggagcggguccgccugucacgacggcaaggaguggaccuacaucggcguggacgggcccgacaacaaugcccugcugaaggugaaguacggcgaggcguacaccgacaccuaccacagcuaugccaacaacauccuccggacgcaggaguccgccugcaacugcaucgggggcaacugcuaucugaugaucaccgacggcagcgccucgggggucuccgagugccgcuuccugaagauccgggagggccgcaucaucaaggagaucuuccccaccgggcgggugaagcauaccgaggagugcacgugcggcuucgccagcaacaagaccaucgagugcgcgugucgcgacaaccgguacaccgccaagcgccccuucgugaagcucaacgucgagaccgacacggccgagauccggcugaugugcaccgauaccuaccuggacaccccgcgccccaacgacggguccaucacgggccccugcgagagcgauggcgacaagggguccggcgggaucaagggcggguucgugcaccagcggaugaaguccaagaucggccgcugguacagccggaccaugucgaagaccgagcgcaugggcauggggcucuaugugaaguacggcgggaaccccugggccgacuccgacgcccugaccuucagcggcgucaugguguccaugaaggagccggggugguacaguuucggcuucgagaucaaggacaagaagugcgacgugcccugcaucggcaucgagaugguccaugacgggggcaaggagacguggcacuccgcggccaccgccaucuacugccugauggggagcggccagcuccugugggacaccgugaccggcguggacauggcccuguga

SEQ ID NO: 28661 - RNA, 1401 nt, Artificial Sequence; identical to SEQ ID NO: 28660
  derived and/or modified CDS sequence (AUadapt) from InfluenzaB__EPI721063__NA

SEQ ID NO: 28662 - RNA, 1401 nt, Artificial Sequence
  derived and/or modified CDS sequence (AUadapt) from InfluenzaB__EPI328903__NA
augcugcccaguaccauccagacccucacgcuguuccugaccuccggcggggugcuccugagccuguacgucuccgcccuccugagcuaccugcucuacuccgauauccugcugaaguucagcccgaccgagaucaccgcccccacgaugucccucgacugcgcgaacgccagcaaugugcaggccgugaaccgcuccgccaccaagggcgucaccuuccugcugcccgagcccgaguggaccuacccgcggcucagcugccccggguccacguuccagaaggcccugcugaucucgccccaucgcuucggcgagaccaaggggaacuccgcgccccucaucauccgggagccguucaucgccugcggccccaacgagugcaagcauuucgcccugacccacuacgccgcgcagcccggcggguacuacaacggcacccgcggggaucggaacaagcugcgccaccucaucagcgugaagcugggcaagauccccacgguggagaacuccaucuuccacauggccgccuggagcggguccgccugucacgacggcaaggaguggaccuacaucggcgucgacgggccggacaacgaugcccugcucaaggugaaguacggcgaggcguacaccgacaccuaccacagcuaugccaacaagauccugcggacgcaggaguccgccugcaacugcaucgggggcaacugcuaccugaugaucaccgauggcagcgccagcgggguguccgagugccgcuuccucaagauccgggagggccgcaucaucaaggagaucuuccccaccgggcgggucaagcacaccgaggaguguacgugcggcuucgccucgaacaagaccaucgagugcgcgugccgcgauaacuccuacaccgccaagcggcccuucgugaagcugaacguggagaccgacacggccgagauccgccugaugugcaccgacaccuaucucgacacgccccggccggacgacgggagcaucaccggccccugcgaguccaacggcgauaaggggagcggcgggaucaagggcggguucguccaccagcgcauggaguccaagaucggccggugguacagccgcaccauguccaagaccgagcggaugggcauggggcuguacgugaaguaugacggcgaccccugggccgacagcgacgcccuggcguucuccggggugauggucagcaugaaggagcccggcugguauuccuucggguucgagaucaaggacaagaagugcgacgugccgugcaucggcaucgagauggugcaugacggcgggaaggagaccuggcacagcgccgccacggccaucuacugccucaugggcuccgggcagcugcugugggacaccgucaccggcguggacauggcccucuga

SEQ ID NO: 28663 - RNA, 1401 nt, Artificial Sequence
  derived and/or modified CDS sequence (AUadapt) from InfluenzaB__EPI543192__NA
augcugcccaguaccauccagacccucacgcuguuccugaccuccggcggggugcuccugagccuguacgucuccgccucgcucuccuaccugcuguaccucgacauccugcugaaguuuccgagcaccgagaucaccgcccccacgaugccccucgacugcgcgaacgccuccaacgugcaggccgugaaccgcucggccaccaagggcgucacccugcugcuccccgagccggaguggaccuauccccggcuguccugccccgggagcacguuccagaaggcccugcucaucucgccccaccgcuucggcgagaccaaggggaacuccgcgccgcugaucauccgggagcccuuuaucgccugcggccccaaggagugcaagcacuucgcccugacccacuacgccgcgcagcccggcggguacuauaacggcacccgcggggaccggaacaagcuccgccaccugaucuccgugaagcugggcaagaucccgacgguggagaacagcaucuuccauauggccgccugguccgggucggccugccacgacggcaaggaguggaccuacaucggcgucgacgggcccgacaauaacgcccuccugaagaucaaguacggcgaggcguacaccgacaccuaccacuccuacgccaauaacauccugcggacgcaggagagcgccugcaacugcaucgggggcaacugcuaccucaugaucaccgauggcuccgccucgggggugagcgagugccgcuuccugaagauccgggagggccgcaucaugaaggagaucuuccccaccgggcggacccagcacacggaggagugcacguguggcuucgccuccaacaagaccaucgagugcgcgugccgcgacaacucguauaccgccaagcggcccuucgugaagcugaacgucgagaccgacaccgccgagauccgccucaugugcaccaagaccuaccuggacacgccgcggcccgacgauggguccaucaccggccccugcgagagcaacggcgggaagggcuccgggggcaucaagggcggguucgugcaccagcgcauggccucgaagaucggccggugguacucccgcaccaugaguaagaccgagcggaaggggaugggccuguacaucaaguacaacggggaccccugggccgacuccgacgcgcucacguucaguggcgugauggucuccauggaggagccggggugguacagcuucggcuucgagaucaaggacaagaagugcgacgugcccuguaucggcaucgagauggugcacgacgggggcaaggagaccuggcacuccgccgccaccgccaucuacugccugauggggagcggccagcugcucugggacaccgucacgggcgugaacaugacccuguga

SEQ ID NO: 28664 - RNA, 1401 nt, Artificial Sequence; identical to SEQ ID NO: 28663
  derived and/or modified CDS sequence (AUadapt) from InfluenzaB__EPI500360__NA

SEQ ID NO: 28665 - RNA, 1401 nt, Artificial Sequence
  derived and/or modified CDS sequence (AUadapt) from InfluenzaB__EPI543186__NA
augcugcccaguaccauccagacccucacgcuguuccugaccuccggcggggugcuccugagccuguacgucuccgccagccucuccuaccugcuguauagcgacauccuccugaaguucucccgcaccgaggugaccgccccgaucaugccccuggacugcgcgaaugccagcaacgugcaggccgucaaccgguccgccacgaagggcgugacgccccuccugcccgagccggaguggaccuacccccgccugagcugucccggguccaccuuccagaaggcccuccugaucucgccccaccgguucggcgagaccaaggggaacuccgcgccgcugaucauccgcgagcccuucaucgccuguggccccaaggagugcaagcacuucgcccucacccacuacgccgcgcagcccggcggguauuacaacggcacccgggaggaccgcaacaagcugcggcaccugaucagugugaagcucgggaagaucccgaccgucgagaacuccaucuuccacauggccgccuggagcggcuccgccugccaugacgggcgcgaguggacguacaucggcguggacggccccgacagcaacgcccugcugaagaucaaguauggggaggcguacaccgacaccuaccacuccuacgccaagaauauccuccggacccaggagagcgccugcaacugcaucggcggggacuguuaccugaugaucacggacggccccgccagcggcaucuccgagugccgcuuccugaagauccgggaggggcgcaucaucaaggagaucuuucccaccggccgggugaagcacaccgaggagugcacgugcggguucgccucgaacaagaccaucgagugugcgugccgcgacaacuccuacaccgccaagcggccguucgucaagcucaauguggagaccgacaccgccgagauccgccugaugugcacgaagaccuaccuggacacgccccggcccaacgauggcagcaucaccgggcccugcgaguccgacggcgacgagggcagcgggggcaucaagggcggguuugugcaccagcgcauggccuccaagaucgggcggugguacagccgcaccauguccaagaccaagcggaugggcaugggccucuacgucaaguacgacggggauccguggaccgacagcgaggcccuggcgcuguccggcgugauggugagcauggaggagcccgggugguacuccuucggcuuugagaucaaggacaagaagugcgacguccccugcaucgggaucgagauggugcacgauggcggcaagaccacguggcacagcgccgccaccgugaucuacugccucaugggguccggccagcugcugugggacaccgucaccggggugaacaugacgcucuga

SEQ ID NO: 28666 - RNA, 1401 nt, Artificial Sequence; identical to SEQ ID NO: 28665
  derived and/or modified CDS sequence (AUadapt) from InfluenzaB__EPI536448__NA

SEQ ID NO: 28667 - RNA, 1401 nt, Artificial Sequence
  derived and/or modified CDS sequence (AUadapt) from InfluenzaB__NP_056663__NA
augcugcccaguaccgugcagacccucacgcugcugcucaccuccggcgggguccugcugagccucuacguguccgccucgcuguccuaccugcucuacagugacgugcugcugaaguucuccagcaccaagaccacggccccgaccaugucccucgagugcaccaacgcgucgaaugcccagaccgucaaccacuccgccacgaaggagaugaccuucccgccgcccgagcccgaguggaccuacccccgccugagcugccagggcuccaccuuucagaaggcccugcucaucagcccccaccgguucggggagaucaagggcaacuccgcgccccugaucauccgcgagcccuucguggccugcgggcccaaggagugucggcacuucgcccugacgcacuacgccgcccagcccggcggcuacuacaaugggacccgcaaggaccggaacaagcuccgccaccuggugucggucaagcugggcaagauccccaccguggagaacuccaucuuccauauggcggccuggagcggguccgccugccacgacggccgggaguggaccuacaucgggguggacggcccggauaacgacgcccucgucaagaucaaguacggcgaggccuacacggacaccuaccauagcuacgcgcacaacauccugcgcacccaggagucggccugcaauugcaucgggggcgacugcuaccugaugaucaccgacggguccgccaguggcaucuccaagugccgguuccucaagauccgcgagggccggaucaucaaggagauccugcccacggggcgcguggagcacaccgaggagugcacgugcggcuucgccaguaacaagaccaucgagugcgccugccgggacaacuccuacaccgcgaagcgccccuuugugaagcugaacgucgagaccgacaccgccgagauccggcucaugugcaccaagacguaccuggacacgccccgcccggacgaugggucgaucgccggccccugcgaguccaacggggacaaguggcugggcggcaucaagggcggguucgugcaccagcggauggccaguaagaucgggcgcugguacucccggaccaugagcaagaccaaccgcaugggcauggagcucuacgugaaguacgacggggaucccuggaccgacuccgacgcccugacccugucgggcgucaugguguccaucgaggagcccggcugguacagcuucggguuugagaucaaggacaagaagugcgacgugccgugcaucggcaucgagaugguccacgacgggggcaaggauaccuggcacuccgcggccaccgccaucuacugccucauggggagcggccagcugcugugggacacggugaccggcguggacauggcccucuga

SEQ ID NO: 28668 - RNA, 1401 nt, Artificial Sequence
  derived and/or modified CDS sequence (AUadapt) from InfluenzaB__ABG85180__NA
augcugcccaguaccgugcagacccucacgcugcugcucaccuccggcgggguccugcugagccucuacguguccgccagccuguccuaccugcucuacagugacgugcugcugaaguucuccagcaccaagaccacggccccgaccaugucccucgagugcaccaacgcgagcaaugcccagaccgucaacuacuccgccacgaaggagaugaccuucccgccgcccgagcccgaguggaccuacccccgccugagcugccagggcuccaccuuucagaaggcccugcucaucucgccccaccgguucggggagaucaagggcaacuccgcgccccugaucauccgcgagcccuucguggccugcgggcccaaggagugucggcacuucgcccugacgcacuacgccgcccagcccggcggcuacuaccaugggacccgcaaggaccggaacaagcuccgccaccuggugagcgucaagcugggcaagauccccaccguggagaacuccaucuuccauauggcggccuggagcggguccgccugccacgacggccgggaguggaccuacaucgggguggacggcccggauaacgacgcccucgucaagaucaaguacggcgaggccuacacggacaccuaccauagcuacgcgcacaacauccugcgcacccaggagucggccugcaauugcaucgggggcgacugcuaccugaugaucaccgacggguccgccaguggcaucuccaagugccgguuccucaagauccgcgagggccggaucaucaaggagauccugcccacggggcgcguggagcacaccgaggagugcacgugcggcuucgccaguaacaagaccaucgagugcgccugccgggacaacuccuacaccgcgaagcgccccuuugugaagcugaacgucgagaccgacaccgccgagauccggcucaugugcaccaagacguaccuggacacgccccgcccggacgaugggagcaucgccggccccugcgaguccaacggggacaagggccugggcgggaucaagggcggguucgugcaccagcggauggccuuuaagaucggccgcugguacucgcggaccauguccaagaccaaccgcauggggauggagcucuacgugaaguacgacggcgaucccuggaccgacagcgacgcccugacccuguccggcgucauggugagcaucgaggagcccgggugguacuccuucggcuuugagaucaaggacaagaagugcgacgugccgugcaucgggaucgagaugguccacgacggcggggaggauaccuggcacagcgcggccaccgccaucuacugccucaugggcuccggccagcugcugugggacacggugaccgggaucgacauggcccucuga

SEQ ID NO: 28669 - RNA, 1401 nt, Artificial Sequence
  derived and/or modified CDS sequence (AUadapt) from InfluenzaB__EPI376345__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaaugccagcaacgugcaggccgugaaccacuccgccgccaagggcgucacgcuccugcugcccgagcccgaguggaccuacccgcgccucaguugccccggguccaccuuccagaaggcgcugcugaucucgccccaccgguucggcgagaucaaggggaacuccgcgccccucaucauccgcgagccguuuaucgccugcggccccaccgagugcaagcacuucgcccugacgcacuaugccgcccagcccggcggguacuacaacggcacccgggaggaccgcaacaagcugcggcaucucaucagcgugaagcuggggaagauccccaccguggagaacuccaucuuccacauggccgccuggagcggcuccgccugccaugacgggaaggaguggaccuacaucggcgucgacggcccggacagcaaugcgcugcucaagaucaaguacggggaggccuacacggacaccuaccacuccuaugccaagaacauccugcgcacccaggagagcgccugcaacugcaucggcggggacuguuaccugaugaucaccgacggccccgccagcggcguguccgagugccgguuccucaagauccgcgaggggcggaucaucaaggagaucuuucccacgggccgcgugaagcacaccgaggagugcacgugcggguucgcgucgaauaagaccaucgagugcgccugccgggacaaccgcuacaccgccaagcggcccuucgucaagcugaauguggagaccgacaccgccgagauccgccugaugugcaccgagacguaccucgacaccccgcggcccaacgauggcuccaucaccgggcccugcgagagcgacggcgacaagggcuccgggggcaucaagggcggguucgugcaucagcgcauggccagcaagaucgggcggugguacucccgcaccaugagcaagacgaagcggaugggcaugggccuguacgucaaguacgacggggaucccuggaccgacuccgaggcgcuggcccucagcggcgugaugguguccauggaggagccggggugguacagcuucggcuuugagaucaaggacaagaagugcgacguccccugcaucgggaucgagauggugcacgauggcggcaagaccaccuggcacuccgccgccacggccaucuacugccugauggggagcggccagcugcucugggacaccgugaccggggucgacauggcgcuguga

SEQ ID NO: 28670 - RNA, 1401 nt, Artificial Sequence; identical to SEQ ID NO: 28669
  derived and/or modified CDS sequence (AUadapt) from InfluenzaB__EPI368424__NA

SEQ ID NO: 28671 - RNA, 1401 nt, Artificial Sequence
  derived and/or modified CDS sequence (AUadapt) from InfluenzaB__EPI331150__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccaugaaccgcuccgccaccaagggcgugacccuccugcugcccgagccggaguggaccuacccccggcucagcugccccggguccacguuccagaaggcccugcugaucagcccccaucgcuucggcgagaccaaggggaacuccgcgccgcucaucauccgggagcccuucaucgccugcggccccaacgagugcaagcacuuugcccugacccacuacgccgcgcagcccggcggguacuacaacggcacccgcggggaccggaauaagcugcgccaccucaucucggucaagcugggcaagaucccgacgguggagaacuccaucuuccacauggccgccuggagcggguccgccugucacgacggcaaggaguggaccuacaucggcguggacgggcccgacaacaacgcccugcucaaggucaaguauggcgaggcguacaccgacaccuaccacagcuacgccaauaagauccugcggacgcaggaguccgccugcaacugcaucgggggcaacugcuaccugaugaucaccgauggcagcgccucggggguguccgagugccgcuuccucaagauccgggagggccgcaucaucaaggagaucuuccccaccgggcgggugaagcacaccgaggaguguacgugcggcuucgccagcaacaagaccaucgagugcgcgugccgcgacaauuccuacaccgccaagcggcccuucgucaagcugaacguggagaccgacacggccgagauccgccugaugugcaccgacaccuaucucgacaccccgcggcccaacgacgggagcaucacgggccccugcgaguccgacggcgauaaggggagcggcgggaucaagggcggguucgugcaccagcgcauggaguccaagaucggccggugguacucgcgcaccauguccaagaccgagcggaugggcauggggcuguacgucaaguacgauggcgaccccugggccgacagcgacgcccuggcguucuccggggugauggugagcaugaaggagccgggcugguauuccuucggguucgagaucaaggacaagaagugcgacguccccugcaucggcaucgagauggugcaugacggcgggaaggagaccuggcacagcgccgccacggccaucuacugccucaugggcuccgggcagcugcugugggacaccgugaccggcgucgacauggcccucuga

SEQ ID NO: 28672 - RNA, 1401 nt, Artificial Sequence; identical to SEQ ID NO: 28671
  derived and/or modified CDS sequence (AUadapt) from InfluenzaB__EPI358089__NA

SEQ ID NO: 28673 - RNA, 1401 nt, Artificial Sequence
  derived and/or modified CDS sequence (AUadapt) from InfluenzaB__ABL76698__NA
augcugcccaguaccauccagacccucacgcuguuccugaccuccggcggggugcuccugagccuguacgucuccgccagccucuccuaucugcuguacagcgacauccuccugaaguucuccccgaccgagaucaccgcccccacgaugccccuggauugcgcgaacgccagcaacgugcaggccgugaaccgcuccgccaccaagggcaugacccuccugcugcccgagccggaguggaccuauccccggcucagcugccccggguccacguuccagaaggcccugcugaucucgccccaucgcuucggcgagacccgggggaacuccgcgccgcucaccauccgcgagcccuucaucgccugcggccccaaggagugcaagcauuucgcccugacccacuacgccgcgcagcccggcggguacuauaacggcacgcgggaggaccgcaacaagcugcggcaccucaucagcgucaagcuggggaagaucccgaccguggagaauuccaucuuccacauggccgccuggagcggcuccgccugccaugacgggcgcgaguggaccuacaucggcguggacggccccgacagcaaugcccugaucaagaucaaguacggggaggcguacaccgacacguaccauuccuacgccaacaacauccuccggacccaggagagcgccuguaacugcaucggcggggacugcuaccugaugaucaccgauggcagcgccuccggcaucucgaagugccgcuuccugaagauccgggaggggcgcaucaucaaggagaucuuucccaccggccgggucgagcacacggaggagugcacgugcggguucgccuccaacaagaccaucgagugugcgugccgcgacaacagcuauaccgccaagcggcccuucgugaagcucaacguggagaccgacaccgccgagauccgccugaugugcaccgagaccuaccuggauacgccgcggcccgacgacggcuccaucaccgggcccugcgagagcaauggcgacaagggccgcgggggcaucaagggcggguucguccaccagcggauggccuccaagaucgggcgcugguacagccggaccauguccaagaccgagcgcaugggcauggagcucuaugugaaguacgacggcgaccccuggacggacagugaggcccuggcgccguccggggugauggucagcauggaggagcccggcugguacuccuucggguucgagaucaaggacaagaagugugacgugcccugcaucggcaucgagauggugcacgacgggggcaagaagaccuggcauagcgccgccaccgccaucuacugccugaugggcuccgggcagcuccugugggacaccgucacgggcguggacauggcccuguga

SEQ ID NO: 28674 - RNA, 1401 nt, Artificial Sequence
  derived and/or modified CDS sequence (AUadapt) from InfluenzaB__AAD42328__NA
augcugcccaguaccauccagacccucacgcuguuccugaccuccggcggggugcuccugagccuguacgucuccgccagccucuccuaucugcuguacagcgacauccuccugaaguucuccccgaccgagaucaccgcccccacgaugccccuggacugugcgaacgccagcaacgugcaggccgugaaccgcuccgccaccaagggcaugacccuccugcugcccgagccggaguggaccuacccccggcucaguugccccggguccacguuccagaaggcccugcugaucagcccccaccgcuucggcgagacccgggggaauuccgcgccgcucaccauccgcgagcccuucaucgccugcggccccaaggagugcaagcacuucgcccugacccauuacgccgcgcagcccggcggguacuacaacggcacgcgggaggaucgcaacaagcugcggcaccucaucagcgucaagcuggggaagaucccgaccguggagaacuccaucuuccauauggccgccuggagcggcuccgccugccacgacgggcgcgaguggaccuacaucggcguggauggccccgacagcaacgcccugaucaagaucaaguacggggaggcguacaccgauacguaccacuccuacgccaacaacauccuccggacccaggagagugccugcaacugcaucggcggggacuguuaccugaugaucaccgacggcagcgccuccggcaucagcaagugccgcuuucugaagauccgggaggggcgcaucaucaaggagaucuuccccaccggccgggucgagcacacggaggagugcacgugcggguucgccuccaauaagaccaucgagugcgcgugccgcgacaacagcuauaccgccaagcggcccuucgugaagcucaacguggagaccgacaccgccgagauccgccugaugugcaccgagaccuaccuggauacgccgcggcccgacgacggcuccaucaccgggcccugcgagagcaauggcgacaagggccgcgggggcaucaagggcggguucguccaccagcggauggccuccaagaucgggcgcugguacucgcggaccauguccaagaccaagcgcaugggcauggagcucuaugugaaguacgacggcgaccccuggaucgacagcgaugcccuggcgccguccggggugauggucagcauggaggagcccggcugguacuccuucggguucgagaucaaggacaagaagugugacgugcccugcaucggcaucgagauggugcacgacgggggcaagaagacguggcacagugccgccaccgccaucuacugccugaugggcuccgggcagcuccugugggacaccgucaccggcguggaccgcagcguguga

SEQ ID NO: 28675 - RNA, 1401 nt, Artificial Sequence
  derived and/or modified CDS sequence (AUadapt) from InfluenzaB__EPI541349__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgaucaugccccuggacugugcgaacgccagcaacgugcaggccgugaaccgcuccgccgccaagggcgucacgcuccugcugcccgagcccgaguggaccuacccgcggcucaguugccccggguccaccuuccagaaggcgcugcugaucagcccccaccgcuucggcgagaucaaggggaauuccgcgccccucaucauccgggagccguucaucgccugcggccccaccgagugcaagcacuucgcccugacgcauuacgccgcccagcccggcggguacuacaacggcacccgcgaggaccggaauaagcugcgccaccucaucagcgugaagcuggggaagauccccaccguggagaacuccaucuuccacauggccgccuggaguggcuccgccugccacgacgggaaggaguggaccuacaucggcgucgacggcccggauucgaacgcgcugcucaagaucaaguacggggaggccuacacggacaccuaucacuccuacgccaagaacauccugcggacccaggagagcgccugcaauugcaucggcggggacugcuaccugaugaucaccgacggccccgccaguggcguguccgagugccgcuuccucaagauccgggaggggcgcaucaucaaggagaucuuccccacgggccgggugaagcacaccgaggagugcacguguggguucgcgagcaacaagaccaucgagugcgccugccgcgauaaccgguacaccgccaagcgccccuucgucaagcugaacguggagaccgacaccgccgagauccggcugauguguaccgagacguaccucgacaccccgcgccccaacgacggcuccaucaccgggcccugcgagagugacggcgacaagggcuccgggggcaucaagggcggguucgugcaccagcggauggccagcaagaucgggcgcugguauucccggaccaugagcaagacgaagcgcaugggcaugggccuguacgucaaguacgacggggaccccuggaccgauuccgaggcgcuggcccucagcggcgugaugguguccauggaggagccggggugguacagcuucggcuucgagaucaaggauaagaagugcgacguccccugcaucgggaucgagauggugcacgacggcggcaagaccaccuggcauuccgccgccacggccaucuacugccugauggggagcggccagcugcucugggacaccgugaccggggucgacauggcgcuguga

SEQ ID NO: 28676 - RNA, 1401 nt, Artificial Sequence; identical to SEQ ID NO: 28646
  derived and/or modified CDS sequence (AUadapt) from InfluenzaB__EPI541759__NA

SEQ ID NO: 28677 - RNA, 1401 nt, Artificial Sequence; identical to SEQ ID NO: 28652
  derived and/or modified CDS sequence (AUadapt) from InfluenzaB__EPI826201__NA

SEQ ID NO: 28678 - RNA, 1401 nt, Artificial Sequence
  derived and/or modified CDS sequence (AUadapt) from InfluenzaB__EPI477398__NA
augcugcccaguaccauccagacccucacgcuguuccugaccuccggcggggugcuccugagccuguacgucuccgccagccucuccuaccugcuguauucggacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaacgaguguaagcacuucgcccugacccacuacgccgcgcagcccggcggguacuacaauggcacccgcggggaccggaacaagcugcgccaccucaucucggugaagcugggcaagaucccgacgguggagaacuccaucuuccauauggccgccuggagcggguccgccugccacgacggcaaggaguggaccuacaucggcgucgacgggcccgauaacaacgcccugcucaaggugaaguacggcgaggcguacaccgacaccuaccauagcuacgccaacaagauccugcggacgcaggaguccgccugcaacugcaucgggggcaauugcuaccugaugaucaccgacggcagcgccucggggguguccgagugucgcuuccucaagauccgggagggccgcaucaucaaggagaucuuccccaccgggcgggucaagcacaccgaggagugcacgugcggcuucgccaguaacaagaccaucgagugcgcgugccgcgacaaccgguacaccgccaagcgccccuuugugaagcugaacguggagaccgacacggccgagauccggcugaugugcaccgacaccuaccucgacaccccgcgccccaaugacggguccaucacgggccccugcgagagcgacggcgacaagggguccggcgggaucaagggcggguucguccaucagcggaugaaguccaagaucggccgcugguacagccggaccaugucgaagaccgagcgcaugggcauggggcuguacgugaaguacgacggcgaucccugggccgacuccgacgcccuggcguucagcggggugauggucuccaugaaggagccgggcugguacagcuuuggguucgagaucaaggacaagaagugcgacgugcccugcaucggcaucgagauggugcacgauggcgggaaggagaccuggcacuccgccgccacggccaucuacugccucaugggcagcgggcagcugcugugggacaccgucaccggcguggacauggcccucuga

SEQ ID NO: 28679 - RNA, 1401 nt, Artificial Sequence; identical to SEQ ID NO: 28678
  derived and/or modified CDS sequence (AUadapt) from InfluenzaB__EPI492570__NA

SEQ ID NO: 28680 - RNA, 1401 nt, Artificial Sequence; identical to SEQ ID NO: 28678
  derived and/or modified CDS sequence (AUadapt) from InfluenzaB__EPI498339__NA

SEQ ID NO: 28681 - RNA, 1401 nt, Artificial Sequence
  derived and/or modified CDS sequence (AUadapt) from InfluenzaB__EPI538118__NA
augcugcccaguaccauccagacccucacgcuguuccugaccuccggcggggugcuccugagccuguacgucuccgccagccucuccuaucugcuguacagcgacauccuccugaaguucucccgcaccgaggugaccgccccgaucaugccccuggacugugcgaacgccagcaacgcccaggccgugaaccgguccgccacgaagggcgucacgccccuccugcccgagccggaguggaccuacccccgccugaguugccccggguccaccuuccagaaggcgcuccugaucucgccccaccgguuuggcgagaccaaggggaacuccgccccgcugaucauccgcgagcccuucaucgccugcggccccaaggagugcaagcacuuugcccucacccacuacgcggcccagcccggcggguacuacaacggcacccgggaggaucgcaacaagcugcggcaccugaucagcgugaagcucgggaagaucccgaccguggagaacuccaucuuucacauggccgccuggagcggcuccgccugccacgacgggcgcgaguggacguauaucggcgucgacggccccgacagcaacgcgcugcugaagaucaaguacggggaggccuauaccgacaccuaccacuccuacgccaagaauauccuccggacccaggagagcgccugcaacugcaucggcggggacuguuaccugaugaucacggacggccccgccagcggcaucuccgagugccgcuuccugaagauccgggaggggcgcaucaucaaggagaucuuucccaccggccgggugaagcacaccgaggagugcacgugcggguucgcgaguaacaagaccaucgagugcgccugccgcgacaacuccuauaccgccaagcggccguucgugaagcucaacgucgagaccgacaccgccgagauccgccugaugugcacgaagaccuaccuggauacgccccggcccaacgacggcagcaucaccgggcccugcgaguccgauggcgacgagggcagcgggggcaucaagggcggguucgugcaccagcgcauggccuccaagaucgggcggugguacagucgcaccauguccaagaccaagcggaugggcaugggccucuacgugaaguacgacggggacccguggaccgacagugaggcgcuggcccuguccggcgucauggugagcauggaggagcccgggugguacuccuucggcuucgagaucaaggauaagaagugcgacgugcccugcaucgggaucgagaugguccacgacggcggcaagaccacguggcauagcgccgccaccgccaucuacugccucaugggguccggccagcugcugugggacaccgugaccggggugaacaugacgcucuga

SEQ ID NO: 28682 - RNA, 1401 nt, Artificial Sequence; identical to SEQ ID NO: 28681
  derived and/or modified CDS sequence (AUadapt) from InfluenzaB__EPI538124__NA

SEQ ID NO: 28683 - RNA, 1401 nt, Artificial Sequence; identical to SEQ ID NO: 28681
  derived and/or modified CDS sequence (AUadapt) from InfluenzaB__EPI556421__NA

SEQ ID NO: 28684 - RNA, 1401 nt, Artificial Sequence; identical to SEQ ID NO: 28681
  derived and/or modified CDS sequence (AUadapt) from InfluenzaB__EPI614609__NA

SEQ ID NO: 28685 - RNA, 1401 nt, Artificial Sequence
  derived and/or modified CDS sequence (AUadapt) from InfluenzaB__BAB32609__NA
augcugcccaguaccauccagacccucacgcuguuccugaccuccggcggggugcuccugagccuguacgucuccgcccuccugucguaccugcucuacuccgacauccugcugaaguucaguccgaccaagaucaucgcccccaccaugucccucgacugcgcgaacgccucgaacgugcaggccgccaaccacuccgccacgaaggagaugaccuuccugcugcccgagcccgaguggaccuauccgcgccucagcugccagggcuccaccuuccagaaggcgcugcugaucucgccccaccgguucggggaggccaagggcaacuccgcgccccucaucauccgcgagcccuucaucgccugcgggccgaaggaguguaagcacuucgcccugacgcacuacgccgcccagcccggcggcuacuacaacgggacccgggaggaccgcaauaagcugcggcaccucaucagcgugaaccugggcaagauccccaccgucgagaacuccaucuuccacauggccgccuggucgggguccgcgugccacgauggccgcgaguggaccuacaucgggguggacggccccgacagcaacgcccugaucaagaucaaguacggcgaggccuacacggacaccuaucacuccuacgccaacaacauccuccggacccaggagucggccugcaacugcaucgggggcgacuguuaccugaugaucaccgacgggagcgcguccggcaucucgaagugccgcuuccugaagauccgggagggccgcaucaucaaggagaucuucccgacggggcggguggagcacaccgaggaguguacgugcggcuucgccuccaacaagaccaucgagugcgccugccgcgacaacagcuacaccgccaagcggcccuuugucaagcucaacguggagaccgacaccgccgagauccgccugaugugcaccgagacguaccuggacacgccccggcccgacgacggguccaucaccggcccgugcgagaguaacggggagaagggccgcggcgggaucaagggcggguucgugcaccagcggauggcguccaagaucggccgcugguacagccggaccauguccaagaccgagcgcauggggauggagcucuacgucaaguacgacggcgaccccuggaccgauucggacgcccuggcccccuccggcgugauggugagcaugaaggagcccgggugguacuccuucggcuucgagaucaaggacaagaagugcgaugucccgugcaucgggaucgagauggugcacgacggcgggaagaagaccuggcacagcgccgccaccgcgaucuacugccugaugggcuccggccagcuccugugggacacggugaccggggucgacauggcccuguga

SEQ ID NO: 28686 - RNA, 1401 nt, Artificial Sequence
  derived and/or modified CDS sequence (AUadapt) from InfluenzaB__EPI271544__NA
augcugcccaguaccauccagacccucacgcuguuccugaccuccggcggggugcuccugagccuguacgucuccgccagccucuccuaccugcuguacagugacauccuccugaaguucucccgcaccgagaucaccgccccgaucaugccccuggacugcgcgaacgccagcaaugugcaggccgugaaccgguccgccacgaagggcgucacccuccugcugcccgagcccgaguggaccuacccgcgccucagcugccccggguccaccuuccagaaggcccugcugaucagcccccaucgguucggcgagacgaaggggaacuccgcgccccucaucauccgcgagccguucaucgccugcggccccaaggagugcaagcacuuugcccugacccacuacgccgcgcagcccggcggguacuacaacggcacccgggaggaccgcaauaagcugcggcaccucaucucggugaagcuggggaagauccccaccguggagaacuccaucuuccacauggccgccuggagcggcuccgccugucacgacgggcgcgaguggacguacaucggcgucgacggcccggacagcaaugcccugcucaagaucaaguacggggaggcguacaccgacaccuaccacuccuacgccaagaauauccugcggacccaggagagcgccugcaacugcaucggcggggacugcuaucugaugaucacggacggccccgccucgggcaucuccgagugccgcuuccucaagauccgggaggggcgcaucaucaaggagaucuuccccaccggccgggugaagcacaccgaggaguguacgugcggguucgccagcaacaagaccaucgagugcgcgugccgcgauaacuccuacaccgccaagcggcccuucgugaagcugaacgucgagaccgacaccgccgagauccgccugaugugcacggagaccuaucucgacaccccgcggcccaacgacggcagcaucaccgggcccugcgaguccaacggcgauaagggcagcgggggcaucaagggcggguucgugcaccagcgcauggccuccaagaucgggcggugguacucgcgcacgauguccaagaccaagcggaugggcaugggccuguacgugaaguaugacggggaccccuggaccgacagcgaggcccuggcgcucuccggcgucauggugagcauggaggagccggggugguacuccuuuggcuucgagaucaaggacaagaagugcgacgugcccugcaucgggaucgagaugguccacgauggcggcaagaccacguggcacagcgccgccaccgccaucuacugccugaugggguccggccagcugcucugggacaccgugaccggggugaacaugacgcuguga

SEQ ID NO: 28687 - RNA, 1401 nt, Artificial Sequence; identical to SEQ ID NO: 28686
  derived and/or modified CDS sequence (AUadapt) from InfluenzaB__AFH57957__NA

SEQ ID NO: 28688 - RNA, 1401 nt, Artificial Sequence; identical to SEQ ID NO: 28686
  derived and/or modified CDS sequence (AUadapt) from InfluenzaB__EPI294881__NA

SEQ ID NO: 28689 - RNA, 1401 nt, Artificial Sequence
  derived and/or modified CDS sequence (AUadapt) from InfluenzaB__ABL77259__NA
augcugcccaguaccauccagacccucacgcuguuccugaccuccggcggggugcuccugagccuguacgucuccgccagccucuccuaccugcuguauucggacauccuccugaaguucuccccgaccgagaucaccgcccccaaggugccccuggacugcgcgaacgccaguaacgugcaggccgucaaccgcuccgccacgaagggcaugacccuccugcugagcgagcccgaguggaccuacccgcggcucuccugccaggggucgaccuuucagaaggcccugcugaucagcccccaccgcuucggcgagacgcgggggaacuccgcgccccucaucauccgcgagcccuucaucgccugcggcccgaaggaguguaagcacuucgcccugacccacuacgccgcgcagcccggcggguacuauaacggcacccgggaggaccgcaacaagcugcggcaccucaucuccgugaagcuggggaagauccccaccguggagaacagcaucuuucacauggccgccugguccggcagcgccugccacgacgggcgcgaguggacguacaucggcgucgauggccccgacuccaacgcccugaucaagaucaaguacggggaggcguacaccgacaccuaccauucguacgccaacaacauccuccggacccaggagagcgccugcaauugcaucggcggggacugcuaccugaugaucacggacggcuccgccaguggcaucuccaagugccgcuuccugaagauccgggaggggcgcaucaucaaggagaucuucccgaccggccggguggagcacaccgaggagugcacgugcggguuugccucgaacaagaccaucgagugcgcgugccgcgacaacuccuauaccgccaagcggcccuucgugaagcucaacgucgagaccgacaccgccgagauccgccugaugugcacggagaccuaccuggacacgccccggcccgaugacggcagcaucaccgggccgugcgaguccaacggcgacaagggccgcgggggcaucaagggcggguuugugcaccagcggauggccagcaagaucgggcgcugguacucccggaccaugucgaagaccgagcgcaugggcauggagcucuacgugaaguacgauggcgaccccuggaccgacuccgacgcccuggcgcccagcggggucaugguguccaugaaggagcccggcugguacagcuuuggguucgagaucaaggacaagaagugcgacgugccgugcaucggcaucgagaugguccacgaugggggcaagaagaccuggcacuccgccgccacggccaucuacugccugaugggcagcgggcagcuccugugggacaccgugaccggcguggacauggcccuguga

SEQ ID NO: 28690 - RNA, 1401 nt, Artificial Sequence
  derived and/or modified CDS sequence (AUadapt) from InfluenzaB__AAN39743__NA
augcugcccaguaccauccagacccucacgcuguuccugaccuccggcggggugcuccugagccuguacgucuccgcccuccugagcuaccugcucuacuccgacauccugcugaaguuuagcccgaccaaggugaucgcccccaccaugucccucgacugcgcgaacgccucgaacgugcaggccgucaaccauuccgccacggaggagaugaccuuccugcugcccgagcccgaguggaccuacccgcgccucagcugccagggcuccaccuuccagaaggcccugcugaucagcccccaccgguucggggaggcgaagggcaauuccgcgccccucaucauccgcgagcccuucaucgccugcgggccgaaggagugcauccacuucgcccugacgcacuacgccgcccagcccggcggcuauuacaacgggacccgggaggaccgcaacaagcugcggcaccucaucagcgugaaccugggcaagauccccaccguggagaauuccaucuuccacauggccgccuggagcggguccgccugccacgacggccgcgaguggaccuacaucggggucgacggccccgauucgaacgcgcugaucaagaucaaguacggcgaggccuacacggacaccuaccacuccuaugccaacaacauccuccggacccaggagagcgccugcaacugcaucgggggcgacuguuaccugaugaucaccgacgggagcgccuccggcaucagccgcugccgguuccugaagauccgcgagggccggaucaucaaggagaucuucccgacggggcgcguggagcacaccgaggaguguacgugcggcuucgcguccaacaagaccaucgagugcgugugccgggacaacaguuacaccgccaagcgccccuucgucaagcucaacguggagaccgacaccgccgagauccggcugaugugcaccgagacguaccuggacacgccccgccccgaugacggguccaucaccggcccgugcgagucgaacggggacaagggcaacggcgggaucaagggcggguucgugcaccagcggauggccucccgcaucggccggugguauagccgcaccauguccaagaccaagcggauggggauggagcucuacgucaaguacgacggcgaccccuggaccgacagcgaugcccuggcgcccuccggcgugauggugagcauggaggagcccgggugguacuccuucggcuucgagaucaaggacaagaagugcgacgucccguguaucgggaucgagauggugcacgacggcgggaagaagaccuggcacagcgccgccaccgccaucuacugccugaugggcuccggccagcuccugugggacacggugaccggggucgacauggcccuguga

SEQ ID NO: 28691 - RNA, 1401 nt, Artificial Sequence
  derived and/or modified CDS sequence (AUadapt) from InfluenzaB__AAN39747__NA
augcugcccaguaccauccagacccucauccuguuccugacguccggcggggugcuccugucgcuguacgucuccgcccuccugagcuaccugcucuacuccgacauccugcugaaguucucgccgaccaagaucaucgcccccaccaugucccucgacugcgcgaacgccaguaacgugcaggccgugaaccacuccgccaccaaggagaugacguuccugcugcccgagcccgaguggaccuacccgcgccucucgugccagggcuccaccuuccagaaggcccugcugaucagcccccaccgguucggggaggcgaagggcaacuccgcgccccucaucauccgcgagcccuucaucgccugugggccgaaggagugcaagcacuucgcccugacccacuacgccgcccagcccggcggcuacuacaacgggacgcgggaggaccgcaacaagcugcggcaccucaucucggucaaccugggcaagauccccaccguggagaauuccaucuuccacauggccgccuggagcggguccgccugccacgacggccgcgaguggaccuacaucgggguggacggccccgacucgaacgcgcugaucaagaucaaguacggcgaggccuacaccgauacguaccacuccuacgccaacaacauccuccggacccaggagucggccugcaacugcaucgggggcgacugcuaccugaugaucaccgacgggagugccuccggcaucucgaagugccgcuuccugaagauccgggagggccgcaucaucaaggagaucuucccgaccgggcgggucgagcacacggaggagugcacgugcggcuucgcguccaacaagaccaucgagugcgccugccgcgacaacaguuacaccgccaagcggcccuucgugaagcucaacguggagaccgacaccgccgagauccgccugaugugcaccaagaccuaccuggacacgccccggcccgacgacggguccaucaccggcccgugcgagucgaacggggacaagggcuccggcgggaucaagggcggguuuguccaccagcgcauggccagcaagaucggccggugguacucccgcaccaugucgaagaccaagcggauggggauggagcucuacgugaaguacgacggcgaccccuggacggacuccgacgcgcuggcccccagcggcgugauggucuccaucgaggagcccgggugguacucguuuggcuucgagaucaaggacaagaagugcgacgugccgugcaucgggaucgagauggugcacgacggcgggaagaagaccuggcacuccgccgccaccgccaucuacugccugaugggcagcggccagcuccugugggacaccgucacggggguggacauggcgcuguga

SEQ ID NO: 28692 - RNA, 1401 nt, Artificial Sequence
  derived and/or modified CDS sequence (AUadapt) from InfluenzaB__AAN39749__NA
augcugcccaguaccauccagacccucacgcuguuccugaccuccggcggggugcuccugagccuguacgucuccgcccuccugagcuaccugcucuacuccgauauccugcugaaguucucgccgaccaaggugaucgcccccaccaugucccucgacugcgcgaacgccagcaacgugcaggccgucaaucacuccgccacggaggagaugaccuuccugcugcccgagcccgaguggaccuacccgcgccucagcugccagggcuccaccuuccagaaggcccugcugaucagcccccaucgguucggggaggcgaagggcaacuccgcgccccucaucauccgcgagcccuucaucgccugcgggccgaaggagugcaagcacuucgcccugacgcauuacgccgcccagcccggcggcuacuacaacgggacccgggaggaccgcaacaagcugcggcaccucaucagugugaaccugggcaagauccccaccguggagaacuccaucuuccacauggccgccuggagcggguccgccugccaugacggccgcgaguggaccuacaucggggucgacggccccgacagcaacgcgcugaucaagaucaaguacggcgaggccuauacggacaccuaccacuccuacgccaacaacauccuccggacccaggagagcgccuguaacugcaucgggggcgacugcuaccugaugaucaccgacgggucggccuccggcaucagucgcugccgguuccugaagauccgcgagggccggaucaucaaggagaucuucccgacggggcgcguggagcacaccgaggagugcacgugcggcuucgcguccaauaagaccaucgagugcgccugccgggacaacagcuacaccgccaagcgccccuuugugaagcucaacgucgagaccgacaccgccgagauccggcugaugugcaccgagacguaccuggacacgccccgccccgacgacggguccaucaccggcccgugugagagcaacggggacaagggcaacggcgggaucaagggcggguucgugcaccagcggauggccucccgcaucggccggugguacagucgcaccauguccaagaccaagcggauggggauggagcucuacgugaaguacgacggcgaccccuggaccgacagcgacgcgcuggcccccuccggcgucauggugaguauggaggagcccgggugguacuccuucggcuucgagaucaaggacaagaagugcgacgugccgugcaucgggaucgagaugguccaugacggcgggaagaagaccuggcacagcgccgccaccgccaucuacugccugaugggcuccggccagcuccugugggacacggugaccgggguggacauggcgcuguga

SEQ ID NO: 28693 - RNA, 1401 nt, Artificial Sequence
  derived and/or modified CDS sequence (AUadapt) from InfluenzaB__AAN39751__NA
augcugcccaguaccauccagacccucacgcuguuccugaccuccggcggggugcuccugagccuguacgucuccgcccuccugagcuaccugcucuacuccgauauccugcugaaguucagcccgaccaaggugaucgcccccaccaugucccucgacugcgcgaacgccagcaaugugcaggccgucaaccacuccgccacggaggagaugaccuuccugcugcccgagcccgaguggaccuacccgcgccucagcugccagggcuccaccuuucagaaggcccugcugaucucgccccaccgguucggggaggcgaagggcaacuccgcgccccucaucauccgcgagcccuucaucgccugcgggccgaaggaguguaagcacuucgcccugacgcacuacgccgcccagcccggcggcuacuacaaugggacccgggaggaccgcaacaagcugcggcaccucaucagcgugaaccugggcaagauccccaccguggagaacuccaucuuucacauggccgccuggagcggguccgccugccacgacggccgcgaguggaccuacaucggggucgauggccccgacagcaacgcgcugaucaagaucaaguacggcgaggccuacacggacaccuaucacuccuacgccaacaacauccuccggacccaggagagcgccugcaauugcaucgggggcgacugcuaccugaugaucaccgacgggagcgccuccggcaucagucgcugccgguuccugaagauccgcgagggccggauccucaaggagaucuucccgacggggcgcguggagcacaccgaggagugcacgugcggcuuugcguccaacaagaccaucgagugcgccugccgggacaacagcuauaccgccaagcgccccuucgugcagcugaacgucgagaccgacaccgccgagauccggcugaugugcaccgagacguaccucgacacgccccgccccgaugacggguccaucaccggcccgugcgagagcaacggggacaagggcaacggcgggaucaagggcggguuugugcaccagcggauggccucccgcaucggccggugguacagccgcaccauguccaagaccaagcggauggggauggaccuguacgugaaguacgauggcgaccccuggaccgacagcgacgcgcuggcccccuccggcgucauggugagcauggaggagcccgggugguacuccuuuggcuucgagaucaaggacaagaagugcgacgugccgugcaucgggaucgagaugguccacgauggcgggaagaagaccuggcacagcgccgccaccgccaucuacugccucaugggcuccggccagcugcugugggacacggugaccgggguggacauggcgcucuga

SEQ ID NO: 28694 - RNA, 1401 nt, Artificial Sequence
  derived and/or modified CDS sequence (AUadapt) from InfluenzaB__AAN39753__NA
augcugcccaguaccauccagacccucacgcuguuccugaccuccggcggggugcuccugagccuguacgucuccgcccuccugagcuaccugcucuacuccgacauccugcugaaguuuucgccgaccaaggugaucgcccccaccaugucccucgacugcgcgaacgccagcaacgugcaggccgucaaccauuccgccacggaggagaugaccuuccugcugcccgagcccgaguggaccuacccgcgccucagcugccagggcuccaccuuccagaaggcccugcugaucucgccccaccgguucggggaggcgaagggcaauuccgcgccccucaucauccgcgagcccuucaucgccugcgggccgaaggagugcaagcacuucgcccugacgcacuacgccgcccagcccggcgaguauuacaacggcacccgggaggaccgcaacaagcugcggcaccucaucagcgugaaccuggggaagauccccaccguggagaauuccaucuuccacauggccgccuggagcggcuccgccugccacgacgggcgcgaguggaccuacaucggcgucgacgggcccgauucgaacgcgcugaucaagaucaaguacggcgaggccuacacggacaccuaccacuccuaugccaacaacauccuccggacccaggagagcgccugcaacugcaucggcggggacuguuaccugaugaucaccgacggcagcgccuccgggaucucgcgcugccgguuccugaagauccgcgagggccggaucaucaaggagaucuucccgacgggccgcguggagcacaccgaggaguguacgugcggguucgcguccaacaagaccaucgagugcgccugccgggacaacaguuacaccgccaagcgccccuucgugaagcucaacgucgagaccgacaccgccgagauccggcugaugugcaccgagacguaccuggacacgccccgccccgaugacggcuccaucaccgggccgugcgagagcaacggcgacaaggggaacggcggcaucaagggcggguucgugcaccagcggauggccucccgcaucgggcggugguauucgcgcaccauguccaagaccaagcggaugggcauggagcucuacgugaaguacgacggggaccccuggaccgacagcgaugcgcuggcccccuccggcgucauggugagcauggaggagcccggcugguacuccuucggguucgagaucaaggacaagaagugcgacgugccguguaucggcaucgagaugguccacgacgggggcaagaagaccuggcacagcgccgccaccgccaucuacugccugaugggguccggccagcuccugugggacacggugaccggcguggacauggcgcuguga

SEQ ID NO: 28695 - RNA, 1401 nt, Artificial Sequence
  derived and/or modified CDS sequence (AUadapt) from InfluenzaB__AAN39759__NA
augcugcccaguaccauccagacccucacgcuguuccugaccuccggcggggugcuccugagccuguacgucuccgccucgcucuccuaccugcuguacagugacauccuccugaagcuguccccgaccgagaucaccgcccccacgaugccccucgacugcgcgaacgccagcaacgugcaggccgugaaucgcuccgccaccaagggcgucacccugcugcuccccgagccggaguggaccuacccccggcugucgugccccggguccacguuccagaaggcccugcucaucagcccccaccgcuuuggcgagaccaaggggaacuccgcgccgcugaucauccgggagcccuucaucgccugcggccccaaggagugcaagcacuucgcccugacccauuacgccgcgcagcccggcggguacuacaacggcacccgcgaggaccggaacaagcuccgccaucugaucagcgugaagcuggggaagaucccgacgguggagaacuccaucuuccacauggccgccuggucgggcuccgccugccaugacgggaaggaguggaccuacaucggcgucgacggccccgacagcaacgcccuccugaagaucaaguauggggaggcguacaccgacaccuaccacuccuacgccaacaauauccugcggacgcaggagagcgccugcaacugcaucggcgggaacugcuaccucaugaucaccgauggcucggccuccggcaucagcgagugccgcuuccugaagauccgggaggggcgcaucaucaaggagaucuuccccaccggccgggugaagcacaccgaggaguguacgugcggguucgccuccaacaagaccaucgagugcgcgugccgcgacaauagcuacaccgccaagcggcccuucgugaagcugaacgucgagaccgacacggccgagauccgccucaugugcaccgagaccuaucuggacaccccgcggcccgacgacggcuccaucacggggcccugcgagucgaacggcgauaagggcuccgggggcaucaagggcggguucgugcaccagcgcauggagagcaagaucgggcggugguacucccgcaccaugagcaagaccaagcggaugggcaugggccuguacgugaaguaugacggggaccccuggaccgacuccgacgcccucgcccugucgggcgucaugguguccaucgaggagccggggugguacaguuucggcuucgagaucaaggacaagaagugcgacgugcccugcaucgggaucgagaugguccaugacggcggcaaggagacguggcacuccgcggccaccgccaucuacugccugauggggagcggccagcuccugugggacaccgugaccgggguggacauggcccuguga

SEQ ID NO: 28696 - RNA, 1401 nt, Artificial Sequence
  derived and/or modified CDS sequence (AUadapt) from InfluenzaB__AAN39761__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgacgaugccccuggacugcgcgaacgccaguaacgugcaggccgugaaccgcuccgccaccaagggcgucacccuccugcugcccgagcccgaguggaccuacccgcggcucagcugccccggguccacguuccagaaggcccugcugaucaguccccaccgcuucggcgagaccaaggggaacuccgcgccccucaucauccgggagccguucaucgccugcggccccaaggaguguaagcacuucgcccugacccacuacgccgcgcagcccggcggguacuacaauggcacccgcgaggaccggaacaagcugcgccaccucaucagcgugaagcuggggaagauccccacgguggagaacuccaucuuccauauggccgccuggucgggcuccgccugccacgacgggcgggaguggaccuacaucggcgucgauggcccggacagcaacgcccugcucaagaucaaguacggggaggcguacaccgacaccuaucacuccuacgccaagaacauccugcgcacgcaggagagcgccugcaacuguaucggcggggacugcuaccugaugaucaccgacggcagcgccuccggcaucagugagugccgguuccucaagauccgcgaggggcggaucaucaaggagaucuuccccaccggccgcaucaagcacaccgaggagugcacgugcggguuugccuccaacaagaccaucgagugcgcgugccgggacaacagcuauaccgccaagcgccccuucgugaagcugaacguggagaccgacacggccgagauccggcugaugugcaccgagaccuaccucgauacgccccgcccggacgacggcuccaucaccgggcccugcgagagcaacggcgacaagggcuccgggggcaucaagggcggguuuguccaccagcggauggccagcaagaucgggcgcugguacucccggaccaugucgaagaccaagcgcaugggcaugggccuguacgugaaguacgauggggaccccuggaccgacuccgaggcccuggcgcucagcggcgugauggucuccauggaggagcccgggugguacagcuuuggcuucgagaucaaggacaagaagugcgacgugccgugcaucgggaucgagauggugcacgauggcggcaagacgaccuggcacuccgccgccaccgccaucuacugccugauggggagcggccagcugcucugggacaccgucacggggguggacauggcccuguga

SEQ ID NO: 28697 - RNA, 1401 nt, Artificial Sequence
  derived and/or modified CDS sequence (AUadapt) from InfluenzaB__AAN39769__NA
augcugcccaguaccauccagacccucacgcuguuccugaccuccggcggggugcuccugagccuguacgucuccgcccuccugucguaccugcucuacuccgacauccugcugaaguucagcccgaccaagaucaucgcccccaccacgucccucgauucggcgaacgccuccaacuuccaggccgugaaccacagcgccaccaaggagaugaccuuccugcugcccgagcccgaguggaccuacccgcgccucuccugucagggcucgacguuccagaaggcccugcugaucagcccccaccgguucggggaggcgaagggcaacuccgcgccccucaucauccgcgagcccuucaucgccugcgggccgaaggagugcaagcacuuugcccugacccacuacgccgcccagcccggcggcuacuacaacgggacccgggaggaccgcaacaagcugcggcaccucaucuccgugaaccugggcaagauccccaccgucgagaauucgaucuuccacauggccgccugguccgggagcgccugccacgacggccgcgaguggacguacaucgggguggacggccccgacuccaaugcgcugaucaagaucaaguacggcgaggccuacaccgacaccuaccacagcuacgccaacaacauccuccggacccaggagagugccugcaacugcaucgggggcgacugcuaccugaugaucacggacggguccgccagcggcaucuccaagugccgcuuucugaagauccgggagggccgcaucaucaaggagaucuucccgaccgggcggguggagcacaccgaggagugcacgugcggcuucgcgucgaacaagaccaucgagugcgccugccgcgacaauuccuacaccgccaagcggcccuucgucaagcucaacguggagaccgacaccgccgagauccgccugaugugcacggagaccuaccuggacacgccccggcccgacgacgggaguaucaccggcccgugcgaguccaacggggacaagggcucgggcgggaucaagggcggguucgugcaccagcgcauggccuccaagaucggccggugguacagccgcaccauguccaagaccaagcggauggggauggagcucuacgucaaguacgauggcgaccccuggaccgacucggacgcgcuggcccccuccggcgugauggugagcaucgaggagcccgggugguacuccuucggcuucgagaucaaggacaagaagugugacgucccgugcaucgggaucgagauggugcacgacggcgggaagaccacguggcacagcgccgccaccgccaucuacugccugaugggcuccggccagcuccugugggacaccgugaccggggucgacauggcgcuguga

SEQ ID NO: 28698 - RNA, 1401 nt, Artificial Sequence
  derived and/or modified CDS sequence (AUadapt) from InfluenzaB__AAN39771__NA
augcugcccaguaccauccagacccucacgcuguuccugaccuccggcggggugcuccugagccuguacgucuccgcccuccugucguaccugcucuacuccgacauccugcugaaguucagcccgaccaagaucaucgcccccaccacgucccucgacagugcgaacgccuccaacuuccaggccgugaaccacagcgccaccaaggagaugaccuuccugcugcccgagcccgaguggaccuacccgcgccucuccugccagggcucgacguuucagaaggcccugcugaucagcccccaccgguucggggaggcgaagggcaacuccgcgccccucaucauccgcgagcccuucaucgccugcgggccgaaggagugcaagcacuucgcccugacccacuacgccgcccagcccggcggcuauuacaacgggacccgggaggaccgcaacaagcugcggcaccucaucuccgugaaccugggcaagauccccaccgucgagaacucgaucuuccacauggccgccugguccgggagugccugccacgacggccgcgaguggacguacaucgggguggacggccccgacuccaacgcgcugaucaagaucaaguacggcgaggccuacaccgacaccuaccauucguacgccaacaacauccuccggacccaggagagcgccugcaacugcaucgggggcgacugcuaucugaugaucacggacggguccgccucgggcaucuccaagugccgcuuccugaagauccgggagggccgcaucgugaaggagaucuucccgaccgggcgggucgagcacaccgaggagugcacgugcggcuucgcgagcaacaagaccaucgagugugccugccgcgacaacuccuacaccgccaagcggcccuucgugaagcucaacguggagaccgacaccgccgagauccgccugaugugcacggagaccuaccuggacacgccccggcccgaugacgggucgaucaccggcccgugcgaguccaacggggacaagggcagcggcgggaucaagggcggguucguccaccagcgcauggccuccaagaucggccggugguacucgcgcaccauguccaagaccaagcggauggggauggagcucuacgugaaguaugacggcgaccccuggaccgacagcgacgcgcuggaccccuccggcgugauggucucgaucgaggagcccgggugguacuccuucggcuucgagaucaaggauaagaagugcgacgugccgugcaucgggaucgagauggugcacgacggcgggaagaccacguggcacagcgccgccaccgccaucuacugccugaugggcuccggccagcuccugugggacaccaucaccggggucgacauggcccuguga

SEQ ID NO: 28699 - RNA, 1401 nt, Artificial Sequence
  derived and/or modified CDS sequence (AUadapt) from InfluenzaB__AAN39773__NA
augcugcccaguaccauccagacccucacgcuguuccugaccuccggcggggugcuccugagccuguacgucuccgcccuccugucguaccugcucuacuccgacauccugcugaaguucagcccgaccaagaucaucgcccccaccacgucccucgacagugcgaacgccuccaacuuccaggccgugaaccacagcgccaccaaggagaugaccuuccugcugcccgagcccgaguggaccuacccgcgccucuccugccagggcucgacguuucagaaggcccugcugaucagcccccaccgguucggggaggcgaagggcaacuccgcgccccucaucauccgcgagcccuucaucgccugcgggccgaaggagugcaagcacuucgcccugacccacuacgccgcccagcccggcggcuauuacaacgggacccgggaggaccgcaacaagcugcggcaccucaucuccgugaacuucggcaagauccccaccgucgagaacucgaucuuccauauggccgccugguccgggagcgccugccacgacggccgcgaguggacguacaucgggguggacggccccgacuccaacgcgcugaucaagaucaaguacggcgaggccuacaccgacaccuaucacagcuacgccaacaacauccugcggacccaggagucggccugcaacugcaucgggggcgacuguuaccucaugaucacggacggguccgccagcggcaucuccaagugccgcuuccugaagauccgggagggccgcaucgugaaggagaucuucccgaccgggcgggucgagcacaccgaggagugcacgugcggcuucgcgucgaauaagaccaucgagugcgccugccgcgacaacuccuacaccgccaagcggcccuucgugaagcugaacguggagaccgacaccgccgagauccgccucaugugcacggagaccuaccuggauacgccccggcccgacgacgggagcaucaccggcccgugcgaguccaacggggacaagggcucgggcgggaucaagggcggguucguccaccagcgcauggccuccaagaucggccggugguacagccgcaccauguccaagaccaagcggauggggauggagcuguaugugaaguacgacggcgaccccuggaccgacucggacgcgcucgcccccuccggcgugauggucagcaucgaggagcccgggugguacuccuucggcuucgagaucaaggauaagaagugcgacgugccgugcaucgggaucgagauggugcacgacggcgggaagaccacguggcacagcgccgccaccgccaucuacugccugaugggcuccggccagcugcucugggacaccaucaccggggucgacauggcgcuguga

SEQ ID NO: 28700 - RNA, 1401 nt, Artificial Sequence
  derived and/or modified CDS sequence (AUadapt) from InfluenzaB__AAN39775__NA
augcugcccaguaccauccagacccucacgcuguuccugaccuccggcggggugcuccugucgcuguacgucuccgcccuccugagcuaccugcucuacuccgacauccugcugaaguucucgccgaccaagaucaucgcccccaccacgucccucgacagcgcgaaugccuccaacuuccaggccgugaaccacucggccaccaaggagaugaccuuccugcugcccgagcccgaguggaccuacccgcgccucuccugccagggcagcacguuccagaaggcccugcugaucucgccccaccgguuuggggaggcgaagggcaacuccgcgccccucaucauccgcgagcccuucaucgccugcgggccgaaggagugcaagcacuucgcccugacccacuacgccgcccagcccggcggcuacuacaacgggacccgggaggaucgcaacaagcugcggcaccucaucuccgugaaccugggcaagauccccaccgucgagaacagcaucuuccacauggccgccugguccgggucggccugccacgacggcaaggaguggacguacaucgggguggauggccccgacuccaacgcgcugaucaagaucaaguacggcgaggccuacaccgacaccuaccacucguacgccaacaacauccuccgcacccaggagagugccugcaacugcaucgggggcgacugcuaccugaugaucacggacggguccgccucgggcaucuccaagugccgguuccugaagauccgcgagggccggaucaucaaggagaucuucccgaccgggcgcguggagcacaccgaggaguguacgugcggcuucgcgagcaacaagaccaucgagugcgccugccgggacaacuccuacaccgccaagcgccccuucgucaagcucaacguggagaccgauaccgccgagauccggcugaugugcacggagaccuaccuggacacgccccgccccgacgacgggucgaucaccggcccgugcgaguccaacggggacaagggcagcggcgggaucaagggcggguucgugcaccagcggauggccuccaagaucggccgcugguauucgcggaccauguccaagaccaagcgcauggggauggagcucuacgucaaguacgacggcgaccccuggaccgacagcgacgcgcuggcccccuccggcgugauggugucgaucgaggagcccgggugguacuccuucggcuuugagaucaaggacaagaagugcgacgucccgugcaucgggaucgagauggugcacgacggcgggaagaccacguggcacagcgccgccaccgccaucuacugccugaugggcuccggccagcuccugugggacaccgugaccggggucgacauggcgcuguga

SEQ ID NO: 28701 - RNA, 1401 nt, Artificial Sequence
  derived and/or modified CDS sequence (AUadapt) from InfluenzaB__AAN39777__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgacgaugccccuggacugcgcgaaugccucgaacgugcaggccgugaaccgcuccgccaccaagggcgucacccuccugccgcccgagcccgaguggaccuacccccggcugagcugucccggguccacguuccagaaggcccuccugaucagcccccaccgcuucggcgagaccaaggggaacuccgcgccgcugaucauccgggagcccuucaucgccuguggccccaaggagugcaagcacuucgcccucacccacuacgccgcgcagcccggcggguauuacaacggcacccgcgaggaccggaacaagcugcgccaccugaucagugugaagcucgggaagaucccgacgguggagaacuccaucuuccacauggccgccuggucgggcuccgccugccacgaugggcgggaguggaccuacaucggcgucgacggccccgacagcaacgcccugcugaagaucaaguauggggaggcguacaccgacaccuaccacuccuacgccaagaauauccuccgcacgcaggagagcgccugcaacugcaucggcggggacugcuaucugaugaucaccgacggcagcgccuccggcaucucggagugccgguuccugaagauccgcgaggggcggaucaucaaggagaucuuucccaccggccgcgugaagcacaccgaggagugcacgugcggguucgccuccaacaagaccaucgagugugcgugccgggacaacagcuacaccgccaagcgccccuucgugaagcucaaugucgagaccgacacggccgagauccggcugaugugcaccgagaccuaccuggacaccccgcgccccgacgauggcuccaucacggggcccugcgagagcaacggcaacaagggcuccgggggcaucaagggcggguucgugcaucagcggauggccagcaagaucgggcgcugguacucccggaccaugucgaagaccaagcgcaugggcaugggccucuacgugaaguacgacggggaucccuggaccgacuccgaggcccuggcgcugagcggcgucaugguguccauggaggagccggggugguacagcuucggcuuugagaucaaggacaagaagugcgacgugcccugcaucgggaucgagaugguccacgauggcggcaagacgaccuggcacuccgccgccaccgccaucuacugccucauggggagcggccagcugcugugggacaccgugacggggguggacauggcccucuga

SEQ ID NO: 28702 - RNA, 1401 nt, Artificial Sequence; identical to SEQ ID NO: 28697
  derived and/or modified CDS sequence (AUadapt) from InfluenzaB__AAN39779__NA

SEQ ID NO: 28703 - RNA, 1401 nt, Artificial Sequence
  derived and/or modified CDS sequence (AUadapt) from InfluenzaB__AAN39781__NA
augcugcccaguaccauccagacccucacgcuguuccugaccuccggcggggugcuccugagccuguacgucuccgccagccucuccuaccugcuguacagugacauccuccugaaguucuccagcaccgagaucaccgccccgacgaugccccugaacugcgcgaacgccuccaacgugcaggccgugaaucacagcgccaccaagggcgucacccucccccugcccgagccggaguggaccuacccccgccuguccugccccgggucgacguuccagaaggcccuccugaucagcccccaucgguucggcgagaccaaggggaacuccgcgccgcugaucauccgcgagcccuucaucgccugcggccccaaggagugcaagcacuucgcccucacccauuacgccgcgcagcccggcggguacuacaacggcacccgggaggaccgcaacaagcugcggcaucugaucuccgugaagcucgggaagaucccgacgguggagaacagcaucuuccacauggccgccugguccggcagcgccugccacgaugggcgcgaguggaccuacaucggcgucgacggccccgacuccaacgcccugcugaagaucaaguacggggaggcguacaccgacaccuaucacucguacgccaacaacauccuccggacgcaggagagcgccugcaauugcaucggcggggacugcuaccugaugaucaccgacggcuccgccagcggcguguccgagugucgcuuccugaagauccgggaggggcgcaucaucaaggagaucuuccccaccggccggguggagcacaccgaggagugcacgugcggguucgccucgaauaagaccaucgagugcgcgugccgcgacaacuccuacaccgccaagcggcccuucgucaagcucaacguggagaccgauacggccgagauccgccugaugugcaccgagaccuaccuggacaccccgcggcccgacgacggcagcaucacggggcccugcgaguccaauggcgacaagggcagcgggggcaucaagggcggguucgugcaccagcgcauggccuccaagaucgggcggugguacucgcgcaccauguccaagaauaagcggaugggcaugggccucuacgucaaguacgacggggaccccuggaucgacagcgacgcccugacccuguccggcgugauggugaguauggaggagccggggugguacuccuucggcuucgagaucaaggacaagaagugcgacguccccugcaucgggaucgagauggugcaugacggcggcaaggagaccuggcacagcgcggccacggccaucuacugccucaugggguccggccagcugcugugggacaccgugaccggggucaacauggcccucuga

SEQ ID NO: 28704 - RNA, 1401 nt, Artificial Sequence
  derived and/or modified CDS sequence (AUadapt) from InfluenzaB__AAN39783__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgacgaugccccuggacugcgcgaacgccaguaacgugcaggccgugaaccgcuccgccaccaagggcgucacccuccugcugcccgagcccgaguggaccuacccgcggcucagcugccccggguccacguuccagaaggcccugcugaucaguccccaccgcuucggcgagaccaaggggaacuccgcgccccucaucauccgggagccguucaucgccugcggccccaaggaguguaagcacuucgcccugacccacuacgccgcgcagcccggcggguacuacaauggcacccgcgaggaccggaacaagcugcgccaccucaucagcgugaagcuggggaagauccccacgguggagaacuccaucuuccauauggccgccuggucgggcuccgccugccacgacgggcgggaguggaccuacaucggcgucgauggcccggacagcaacgcccugcucaagaucaaguacggggaggcguacaccgacaccuaucacuccuacgccaagaacauccugcgcacgcaggagagcgccugcaacuguaucggcggggacugcuaccugaugaucaccgacggcagcgccuccggcaucagugagugccgguuccucaagauccgcgaggggcggaucaucaaggagaucuuccccaccggccgcgugaagcacaccgaggagugcacgugcggguuugccuccaacaagaccaucgagugcgcgugccgggacaacagcuauaccgccaagcgccccuucgugaagcugaacgucgagaccgacacggccgagauccggcugaugugcaccgagaccuaccucgauacgccccgcccgaacgacggcuccaucaccgggcccugcgagagcaacggcgacaagggcuccgggggcaucaagggcggguuugugcaccagcggauggccagcaagaucgggcgcugguacucccggaccaugucgaagaccaagcgcaugggcaugggccuguacgugaaguacgauggggaccccuggaccgacuccgaggcccuggcgcucagcggcgucaugguguccauggaggagcccgggugguacagcuuuggcuucgagaucaaggacaagaagugcgacgugccgugcaucgggaucgagaugguccacgauggcggcaagacgaccuggcacuccgccgccaccgccaucuacugccugauggggagcggccagcugcucugggacaccgugacggggguggacauggcccuguga

SEQ ID NO: 28705 - RNA, 1401 nt, Artificial Sequence
  derived and/or modified CDS sequence (AUadapt) from InfluenzaB__AAN39785__NA
augcugcccaguaccauccagacccucacgcuguuccugaccuccggcggggugcuccugagccuguacgucuccgcccuccugagcuaccugcucuacuccgacauccugcugaaguuuucgccgaccaaggugaucgcccccaccaugucccucgacuacgcgaacgccagcaacgugcaggccgucaaccauuccgccacggaggagaugaccuuccugcugcccgagcccgaguggaccuacccgcgccucagcugccagggcuccaccuuccagaaggcccugcugaucucgccccaccgguucggggaggcgaagggcaauuccgcgccccucaucauccgcgagcccuucaucgccugcgggccgaaggagugcaagcacuucgcccugacgcacuacgccgcccagcccggcggcuauuacaacgggacccgggaggaccgcaacaagcugcggcaccucaucagcgugaaccugggcaagauccccaccguggagaauuccaucuuccacauggccgccuggagcggguccgccugccacgacggccgcgaguggaccuacaucggggucgacggccccgauagcaacgcgcugaucaagaucaaguacggcgaggccuacacggacaccuaccacuccuaugccaacaacauccuccggacccaggagucggccugcaacugcaucgggggcgacuguuaccugaugaucaccgacgggagcgccuccggcaucagccgcugccgguuccugaagauccgcgagggccggaucaucaaggagaucuucccgacggggcgcguggagcacaccgaggaguguacgugcggcuucgcguccaacaagaccaucgagugcgccugccgggacaacaguuacaccgccaagcgccccuucgugaagcucaacgucgagaccgacaccgccgagauccggcugaugugcaccgagacguaccuggacacgccccgccccgaugacggguccaucaccggcccgugcgagagcaacggggacaagggcuccggcgggaucaagggcggguucgugcaccagcggaugaccagccgcaucggccggugguauucccgcaccaugucgaagaccaagcggauggggauggagcucuacgugaaguacgacggcgaccccuggaccgacuccgacgcccuggcgcccaguggcgucaugguguccauggaggagcccgggugguacagcuucggcuucgagaucaaggacaagaagugcgacgugccguguaucgggaucgagaugguccacgacggcgggaagaagaccuggcacuccgccgccacggccaucuacugccugaugggcagcggccagcuccugugggacaccgugaccgggguggacauggcccuguga

SEQ ID NO: 28706 - RNA, 1401 nt, Artificial Sequence
  derived and/or modified CDS sequence (AUadapt) from InfluenzaB__AAN39787__NA
augcugcccaguaccauccagacccucacgcuguuccugaccuccggcggggugcuccugagccuguacgucuccgcccuccugagcuaccugcucuacuccgacauccugcugaaguuuucgccgaccaaggugaucgcccccaccaugucccucgacuacgcgaacgccagcaacgugcaggccgucaaccauuccgccacggaggagaugaccuuccugcugcccgagcccgaguggaccuacccgcgccucagcugccagggcuccaccuuccagaaggcccugcugaucucgccccaccgguucggggaggcgaagggcaauuccgcgccccucaucauccgcgagcccuucaucgccugcgggccgaaggagugcaagcacuucgcccugacgcacuacgccgcccagcccggcggcuauuacaacgggacccgggaggaccgcaacaagcugcggcaccucaucagcgugaaccugggcaagauccccaccguggagaauuccaucuuccacauggccgccuggagcggguccgccugccacgacggccgcgaguggaccuacaucggggucgacggccccgauucgaacgcgcugaucaagaucaaguacggcgaggccuacacggacaccuaccacuccuaugccaacaacauccuccggacccaggagagcgccugcaacugcaucgggggcgacuguuaccugaugaucaccgacgggagcgccuccggcaucucgcgcugccgguuccugaagauccgcgagggccggaucaucaaggagaucuucccgacggggcgcguggagcacaccgaggaguguacgugcggcuucgcguccaacaagaccaucgagugcgccugccgggacaacaguuacaccgccaagcgccccuucgugaagcucaacgucgagaccgacaccgccgagauccggcugaugugcaccgagacguaccuggacacgccccgccccgaugacggguccaucaccggcccgugcgagagcaacggggacaagggcaacggcgggaucaagggcggguucgugcaccagcggauggccucccgcaucggccggugguauucgcgcaccauguccaagaccaagcggauggggauggagcucuacgugaaguacgacggcgaccccuggaccgacagcgaugcgcuggcccccuccggcgucauggugagcauggaggagcccgggugguacuccuucggcuucgagaucaaggacaagaagugcgacgugccguguaucgggaucgagaugguccacgacggcgggaagaagaccuggcacagcgccgccaccgccaucuacugccugaugggcuccggccagcuccugugggacacggugaccgggguggacauggcgcuguga

SEQ ID NO: 28707 - RNA, 1401 nt, Artificial Sequence
  derived and/or modified CDS sequence (AUadapt) from InfluenzaB__AAN39795__NA
augcugcccaguaccauccagacccucacgcuguuccugaccuccggcggggugcuccugagccuguacgucuccgccagccucuccuaucugcuguacagcgacauccuccugaaguucuccccgaccgagaucaccgcccccacgaugccccuggauugcgcgaacgccagcaacgugcaggccgugaaucgcuccgccaccaagggcgucacccuccugcugcccgagccggaguggaccuacccccggcucagcugccccggguccacguuccagaaggcccugcugaucagcccccaucgcuucggcgagacccgggggaacuccgcgccgcucaucauccgcgagcccuucaucgccugcggccccaaggaguguaagcacuucgcccugacccacuacgccgcgcagcccggcggguauuacaacggcacccgggaggaccgcaacaagcugcggcaccucaucagugugaagcuggggaagaucccgacgguggagaacuccaucuuccacauggccgccuggagcggcuccgccugucacgacgggcgcgaguggaccuacaucggcgucgacggccccgauucgaacgcccugcucaagaucaaguacggggaggcguacaccgacaccuaucacuccuacgccaacaacauccugcggacgcaggagagugccugcaacugcaucggcggggacuguuaccugaugaucaccgacggcagcgccuccggcaccagcaagugucgcuuccucaagauccgggaggggcgcaucaucaaggagaucuuccccaccggccggguggagcacacggaggagugcacgugcggguuugccuccaacaagaccaucgagugcgcgugccgcgacaauaacuacaccgccaagcggcccuucgugaagcugaacgucgagaccgaugccgccgagauccgccugaugugcaccgagaccuaccucgacaccccgcggcccgacgacggcaguaucacggggcccugcgaguccaacggcgacaagggccgcgggggcaucaagggcggguucgugcaucagcggauggccagcaagaucgggcgcugguacucccggaccaugagcaagaccgagcgcaugggcauggagcuguacgugaaguaugacggcgaccccuggaccgacuccgacgcgcuggcccucagcggggucaugguguccauggaggagccgggcugguauagcuucggguucgagaucaaggacaagaagugugacgugcccugcaucggcaucgagaugguccacgacgggggcaagaagacguggcauuccgccgccaccgccaucuacugccugaugggcagcgggcagcugcucugggacaccgugaccggcguggacauggcgcuguga

SEQ ID NO: 28708 - RNA, 1401 nt, Artificial Sequence; identical to SEQ ID NO: 28692
  derived and/or modified CDS sequence (AUadapt) from InfluenzaB__AAN39797__NA

SEQ ID NO: 28709 - RNA, 1401 nt, Artificial Sequence
  derived and/or modified CDS sequence (AUadapt) from InfluenzaB__AAN39799__NA
augcugcccaguaccauccagacccucacgcuguuccugaccuccggcggggugcuccugagccuguacgucuccgcccuccugagcuaccugcucuacuccgacgugcugcugaaguuuucgccgaccaagaucaucgcccccaccaugucccucgacugcgcgaacgccagcaacgugcaggccgucaaccacuccgccacggaggagaugaccuuucugcugcccgagcccgaguggaccuacccgcgccucagcugccagggcuccaccuuccagaaggcccugcugaucucgccccaccgguucggggaggcgaagggcaacuccgcgccccucaucauccgcgagcccuuuaucgccugcgggccgaaggagugcaagcacuucgcccugacgcacuacgccgcccagcccggcggcuacuacaaugggacccgggaggaccgcaacaagcugcggcaccucaucagcgugaaccugggcaagauccccaccguggagaacuccaucuuccacauggccgccuggaguggguccgccugccacgacggccgcgaguggaccuacaucggggucgacggccccgacagcaacgcgcugaucaagaucgaguauggcgaggccuacacggacaccuaccacuccuacgccuacaacauccuccggacccaggagucggccuguaacugcaucgggggcgacugcuaccugaugaucaccgacgggagcgccuccggcaucagcaagugucgcuuccugaagauccgggagggccgcaucaucaaggagaucuucccgacggggcggguggagcacaccgaggagugcacgugcggcuucgcguccaacaagaccaucgagugcgccugucgcgacaacucguacaccgccaagcggcccuucgugaagcucaacgucgagaccgacaccgccgagauccgccugaugugcaccgagacguaucuggacacgccccggcccgacgacggguccaucaccggcccgugcgagagcaacggggacaagggcuccggcgggaucaagggcggguucgugcaucagcgcauggccagcaagaucggccggugguacucccgcaccaugucgaagaccaagcggauggggauggagcucuacgugaaguacgacggcgaccccuggaccgacuccgaugcgcuggcccccagcggcgucaugguguccauggaggagcccgggugguacagcuucggcuucgagaucaaggacaagaagugcgacgugccguguaucgggaucgagaugguccacgacggcgggaagaagaccuggcacuccgccgccaccgccaucuacugccugaugggcagcggccagcuccugugggacacggugaccgggguggacauggcgcuguga

SEQ ID NO: 28710 - RNA, 1401 nt, Artificial Sequence
  derived and/or modified CDS sequence (AUadapt) from InfluenzaB__AAN39801__NA
augcugcccaguaccauccagacccucacgcuguuccugaccuccggcggggugcuccugagccuguacgucuccgccagccucuccuaccugcuguauucggacauccuccugaaguucuccccgaccgagaucaccgcccccacgaugccccuggacugcgcgaacgccaguaacgcccaggccgugaaccgcuccgccaccaagggcgugacccuccugcugcccgagccggaguggaccuacccccggcucagcugccccggguccacguuccagaaggcgcugcugaucaguccccaccgcuucggcgagaccaaggggaacuccgccccgcucaucauccgggagcccuucaucgccugcggccccaaggagugcaagcauuucgcccugacccacuacgcggcccagcccggcggguacuacaauggcacccgcgaggaccggaacaagcugcgccaccucaucagcgucaagcuggggaagaucccgacgguggagaacuccaucuuccauauggccgccuggagcggcuccgccugccacgacgggaaggaguggaccuacaucggcguggacggccccgauagcaacgcgcugcucaagaucaaguacggggaggccuacaccgacaccuaccauuccuacgccaacaacauccugcggacgcaggagucggccugcaacuguaucggcgggaacugcuaccugaugaucaccgacggcagcgccuccggcaucagugagugccgcuuccucaagauccgggaggggcgcaucaucaaggagaucuuccccaccggccgggucaagcacaccgaggagugcacgugcggguuugcguccaacaagaccaucgagugcgccugccgcgacaacucguauaccgccaagcggcccuucgugaagcugaacguggagaccgacacggccgagauccgccugaugugcaccgagaccuaccucgacaccccgcggcccgaugacggcuccaucacggggcccugcgagagcaacggcgacaagggcuccgggggcaucaagggcggguuuguccaccagcgcauggccagcaagaucgggcggugguacucccgcaccaugucgaagaccaagcggaugggcaugggccuguacgugaaguacgauggggaccccuggaccgacuccgacgcgcuggcccucagcggcgugauggucuccauggaggagccggggugguacagcuuuggcuucgagaucaaggacaagaagugcgacgugcccugcaucgggaucgagauggugcacgauggcggcaaggagacguggcacuccgccgccaccgccaucuacugccugauggggagcggccagcugcucugggacaccgucaccgggguggacauggcgcuguga

SEQ ID NO: 28711 - RNA, 1401 nt, Artificial Sequence
  derived and/or modified CDS sequence (AUadapt) from InfluenzaB__AAN39803__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccaaggugccccuggacugcgcgaaugccucgaacgugcaggccgucaaccgcuccgccacgaagggcaugacccuccugcugagcgagcccgaguggaccuacccgcggcucuccugccaggggaguaccuuccagaaggcccugcugaucagcccccaccgcuucggcgagacgcgggggaacuccgcgccccucaucauccgcgagcccuuuaucgccugcggcccgaaggagugcaagcacuucgcccugacccacuacgccgcgcagcccggcggguauuacaacggcacccgggaggaccgcaacaagcugcggcaccucaucuccgugaagcuggggaagauccccaccguggagaauucgaucuuccacauggccgccugguccggcagcgccugccaugacgggcgcgaguggacguacaucggccuggacggccccgacuccaacgcccucaucaagaucaaguacggggaggcguauaccgacaccuaccacagcuacgccaauaacauccugcggacccaggagagcgccugcaacugcaucggcggggacuguuaccugaugaucacggacggcuccgccucgggcaucuccaagugccgcuuccucaagauccgggaggggcgcaucaucaaggagaucuuuccgaccggccgggucgagcacaccgaggagugcacgugcggguucgccagcaacaagaccaucgagugugcgugccgcgacaacuccuacaccgccaagcggcccuucgugaagcugaauguggagaccgacaccgccgagauccgccugaugugcacggagaccuaccucgacacgccccggcccgacgauggcagcaucaccgggccgugcgaguccaacggcgacaagggccgcgggggcaucaagggcggguucguccaccagcggauggccaguaagaucgggcgcugguacucccggaccaugucgaagaccgagcgcaugggcauggagcuguacgugaaguacgacggcgaucccuggaccgacuccgacgcccuggcgcccagcggggugauggucuccaugaaggagcccggcugguacagcuucggguuugagaucaaggacaagaagugcgacgugccgugcaucggcaucgagauggugcacgaugggggcaaggagaccuggcacuccgccgccacggccaucuacugccucaugggcagcgggcagcugcugugggacaccgucaccggcguggacauggcccucuga

SEQ ID NO: 28712 - RNA, 1401 nt, Artificial Sequence
  derived and/or modified CDS sequence (AUadapt) from InfluenzaB__ABA02232__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccgcuccgccaccaagggcgucacccuccugcugcccgagccggaguggaccuacccccggcucagcugccccggguccacguuccagaaggcccugcugaucucgccccaucgcuucggcgagaccaaggggaacuccgcgccgcucaucauccgggagcccuucaucgccugcggccccaaggagugcaagcacuuugcccugacccacuacgccgcgcagcccggcggguacuacaacggcacccgcggggaccggaauaagcugcgccaccucaucagcgugaagcugggcaagaucccgacgguggagaacuccaucuuccacauggccgccuggagcggguccgccugucacgacggcaaggaguggaccuacaucggcgucgacgggcccgagaacaacgcccugcucaagaucaaguauggcgaggcguacaccgacaccuaccacucguacgccaauaacauccugcggacgcaggaguccgccugcaacugcaucgggggcaacugcuaccugaugaucaccgauggcagcgccagcgggaucuccgagugccgcuuccucaagauccgggagggccgcaucaucaaggagaucuuccccaccgggcgggugaagcacaccgaggaguguacgugcggcuucgccucgaacaagaccaucgagugcgcgugccgcgauaacuccuacaccgccaagcggcccuucgugaagcugaacgucgagaccgacacggccgagauccgccugaugugcaccgagaccuaucucgacaccccgcggcccgacgacgggagcaucacgggccccugcgaguccaacggcgauaaggggagcggcgggaucaagggcggguucgugcaccagcgcauggccuccaagaucggccggugguacucgcgcaccauguccaagaccaagcggaugggcauggggcuguacgugaaguaugacggcgaccccuggaccgacagcgacgcccuggcgcucuccggggucauggugagcauggaggagccgggcugguauuccuucggguucgagaucaaggacaagaagugcgacgugcccugcaucggcaucgagaugguccaugacggcgggaaggagacguggcacagcgccgccaccgccaucuacugccugaugggcuccgggcagcugcucugggacaccgugaccggcguggacauggcccuguga

SEQ ID NO: 28713 - RNA, 1401 nt, Artificial Sequence
  derived and/or modified CDS sequence (AUadapt) from InfluenzaB__ABI84039__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccucgaaugugcaggccgugaaccgcuccgccaccaagggcgucacccuccugcugcccgagccggaguggaccuacccccggcucagcugccccggguccacguuccagaaggcccugcugaucagcccccaccgcuuuggcgagaccaaggggaacuccgcgccgcucaucauccgggagcccuucaucgccugcggccccaacgagugcaagcacuuugcccugacccacuacgccgcgcagcccggcggguacuacaacggcacccgcggggaccggaauaagcugcgccaccucaucagcgugaagcugggcaagaucccgacgguggagaacuccaucuuccacauggccgccuggagcggguccgccugccaugacggcaaggaguggaccuacaucggcgucgacgggcccgacaacaacgcccugcucaagaucaaguauggcgaggcguacaccgacaccuaccacucguacgccaauaacauccugcggacgcaggaguccgccugcaacugcaucgggggcaacugcuaccugaugaucaccgauggcagcgccagcgggguguccgagugccgcuuccucaagauccgggagggccgcaucaucaaggagaucuuccccaccgggcgggugaaguacaccgaggaguguacgugcggcuucgccagcaacaagaccaucgagugcgcgugccgcgauaacuccuacaccgccaagcggcccuucgucaagcugaacguggagaccgacacggccgagauccgccugaugugcaccgacaccuaucucgacaccccgcggcccgacgacgggagcaucacgggccccugcgaguccaacggcgauaaggggucgggcgggaucaagggcggguucgugcaccagcgcauggccuccaagaucggccggugguacagccgcaccauguccaagaccgagcggaugggcauggggcuguacgucaaguaugacggcgaccccugggccgacagcgacgcgcuggccuucuccggggugauggugagcaugaaggagccgggcugguauuccuucggguucgagaucaaggacaagaagugcgacguccccugcaucggcaucgagauggugcaugacggcgggaaggagaccuggcacagcgccgccacggccaucuacugccucaugggcuccgggcagcugcugugggacaccgugaccggcgucgacauggcgcucuga

SEQ ID NO: 28714 - RNA, 1401 nt, Artificial Sequence
  derived and/or modified CDS sequence (AUadapt) from InfluenzaB__ABI84051__NA
augcugcccaguaccauccagacccucacgcuguuccugaccuccggcggggugcuccugagccuguacgucuccgccagccucuccuaccugcuguauagcgacauccuccugcgcuucucccagaccgagaucaccgccccgaucaugccccuggacugcgcgaaugccagcaacgugcaggccgugaaccacuccgccacgaagggcgucacccuccugcugcccgagcccgaguggaccuacccgcggcucaguugccccggguccaccuuccagaaggcccugcugaucucgccccaccgcuucggcgagacgaaggggaacuccgcgccccucaucauccgggagccguuuaucgccugcggccccaaggagugcaagcacuucgcccugacccacuaugccgcgcagcccggcggguacuacaacggcacccgcgaggaccggaacaagcugcgccaucucaucagcgugaagcuggggaagauccccaccguggagaacuccaucuuccacauggccgccuggagcggcuccgccugccaugacgggcgggaguggacguacaucggcgucgacggcccggacagcaaugcccugcucaagaucaaguacggggaggcguacaccgacaccuaccacuccuaugccaagaacauccugcgcacccaggagagcgccugcaacugcaucggcggggacuguuaccugaugaucacggacggccccgccagcggcaucuccgagugccgguuccucaagauccgcgaggggcggaucaucaaggagaucuuucccaccggccgcgugaagcacaccgaggagugcacgugcggguucgccucgaauaagaccaucgagugcgcgugccgggacaacuccuacaccgccaagcgccccuucgugaagcugaaugucgagaccgacaccgccgagauccggcugaugugcacggagaccuaccucgacaccccgcgccccaacgauggcagcaucaccgggcccugcgaguccaacggcgacaagggcagcgggggcaucaagggcggguuugugcaccagcggauggccuccaagaucgggcgcugguacagccggacgauguccaagaccaagcgcaugggcaugggccuguacgugaaguacgacggggaucccuggaccgacagcgaggcccuggcgcucuccggcgucauggugagcauggaggagccggggugguacuccuucggcuuugagaucaaggacaagaagugcgacgugcccugcaucgggaucgagaugguccacgauggcggcaagaccacguggcacagcgccgccaccgccaucuacugccugaugggguccggccagcugcucugggacaccgugaccgggguggacauggcccuguga

SEQ ID NO: 28715 - RNA, 1401 nt, Artificial Sequence
  derived and/or modified CDS sequence (AUadapt) from InfluenzaB__ABI84062__NA
augcugcccaguaccauccagacccucacgcuguuccugaccuccggcggggugcuccugagccuguacgucuccgccagccucuccuaccugcuguacagugacauccuccugaaguucuccccgaccgagaucaucgcccccaucaugccccuggacugcgcgaacgccagcaaugugcaggccgugaaccgcuccaccacgaagggcgucacccuccugcugcccgagccggaguggaccuacccccggcucagcugccccggguccaccuuccagaaggcccugcugaucagcccccaucgcuucggcgagacgaaggggaacuccgccccgcucaucauccgggagcccuucaucgcgugcggccccaaggagugcaagcacuuugcccugacccacuacgccgcccagcccggcggguacuacaacggcacccgcggggaccggaauaagcugcgccaccucaucucggugaagcugggcaagaucccgaccguggagaacuccaucuuccacauggcggccuggagcggguccgccugccaugacggcaaggaguggacguacaucggcgucgacgggcccgacaacaacgcccugcucaagaucaaguauggcgaggccuacaccgacaccuaccacagcuacgcgaauaacauccugcggacccaggaguccgccugcaacugcaucgggggcaacugcuaucugaugaucacggacggccccgccagcgggaucucggagugccgcuuccucaagauccgggagggccgcaucaucaaggagaucuuccccaccgggcgggugaagcauaccgaggagugcacgugcggcuucgccuccaacaagaccaucgagugcgccugccgcgauaacagcuacaccgcgaagcggccguucgugaagcugaacgucgagaccgacaccgccgagauccgccugaugugcacggagaccuaucucgacacgccccggcccgacgacggguccaucaccggccccugcgagagcaacggcgauaagggguccggcgggaucaagggcggguucgugcaccagcgcauggccagcaagaucggccggugguacucccgcaccaugucgaagaccgagcggaugggcauggggcuguacgugaaguaugacggcgacccgugggccgacuccgacgcccuggcgcucagcggggucaugguguccauggaggagcccggcugguacaguuucggguucgagaucaaggacaagaagugcgacgugcccugcaucggcaucgagaugguccaugacggcgggaaggagaccuggcacuccgccgccaccgccaucuacugccugaugggcagcgggcagcugcucugggacacggugaccggcguggacauggcccuguga

SEQ ID NO: 28716 - RNA, 1401 nt, Artificial Sequence
  derived and/or modified CDS sequence (AUadapt) from InfluenzaB__ABL76280__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccugaacugcgcgaacgccucgaaugugcaggccgugaaccgcuccgccaccaagggcgucacccuccugcugcccgagccggaguggaccuacccccggcucagcugccccggguccacguuccagaaggcccugcugaucagcccccaucgcuucggcgagaccaaggggaacuccgcgccgcucaucauccgggagcccuucaucgccugcggccccaaggagugcaagcacuuugcccugacccacuacgccgcgcagcccggcggguacuacaacggcacccgcgaggaccggaauaagcugcgccaccucaucagcgugaagcuggggaagaucccgacgguggagaacuccaucuuccacauggccgccuggucgggcuccgccugccaugacgggcgggaguggaccuacaucggcgucgacggccccgacagcaacgcccugcucaagaucaaguauggggaggcguacaccgacaccuaccacuccuacgccaacaauauccugcgcacgcaggagagcgccugcaacugcaucggcggggacugcuaucugaugaucaccgacggcagcgccuccggcaucucggagugccgguuccucaagauccgcgaggggcggaucaucaaggagaucuuccccaccggccgcguggagcauaccgaggagugcacgugcggguucgccuccaacaagaccaucgagugcgcgugccgggauaacagcuacaccgccaagcgccccuucgugaagcugaacgucgagaccgacacggccgagauccggcugaugugcaccgagaccuaucucgacaccccgcgccccgacgacggcuccaucacggggcccugcgagagcaacggcgauaagggcuccgggggcaucaagggcggguucgugcaccagcggauggccagcaagaucgggcgcugguacucccggaccaugucgaagaccaagcgcaugggcaugggccuguacgugaaguaugacggggaccccuggaucgacuccgacgcccugacccucagcggcgucaugguguccauggaggagccggggugguacaguuucggcuucgagaucaaggacaagaagugcgacgugcccugcaucgggaucgagaugguccaugacggcggcaagaagacguggcacuccgcggccaccgccaucuacugccugauggggagcggccagcugcucugggacaccgugaccgggguggacauggcccuguga

SEQ ID NO: 28717 - RNA, 1401 nt, Artificial Sequence
  derived and/or modified CDS sequence (AUadapt) from InfluenzaB__ABL76302__NA
augcugcccaguaccauccagacccucacgcuguuccugaccuccggcggggugcuccugagccuguacgucuccgccagccucuccuaccugcuguauagcgacauccuccugaaguucccgcccaccgagaucaccgcccccacgaugccccuggacugcgcgaaugccuccaacgugcaggccgugaaccgcucggccaccaagggcgucacccuccugcugccggagcccgaguggaccuacccccggcucuccugccccgggagcacguuucagaaggcccugcugaucuccccgcaccgcuucggcgagaccaaggggaacagcgcgccccucaucauccgggagcccuucaucgccuguggccccaaggagugcaagcacuucgcccugacccacuacgccgcgcagccgggcggguauuacaacggcacccgcgaggaccggaacaagcugcgccaccucaucuccgugaagcuggggaagauccccacgguggagaacaguaucuuccacauggccgccugguccggcagcgccugccacgaugggcgggaguggaccuacaucggcgucgacggccccgacuccaacgcccugcucaagaucaaguacggggaggcguauaccgacaccuaccacucguacgccaacaauauccugcgcacgcaggaguccgccugcaacugcaucggcgggaacugcuaucugaugaucaccgacggcagcgccagcggcaucuccgagugccgguuccucaagauccgcgaggggcggaucaucaaggagaucuuccccaccggccgcgugaagcauaccgaggagugcacgugcggguucgccagcaacaagaccaucgagugugcgugccgggacaacuccuacaccgccaagcgcccguucgugaagcugaaugucgagaccgacacggccgagauccggcugaugugcaccgagaccuaccucgacacgccccgccccgacgacggcaguaucaccgggcccugcgaguccaacggcgacaagggcucggggggcaucaagggcggguucgugcaucagcggauggccuccaagaucgggcgcugguacagccggaccauguccaagaccaagcgcaugggcaugggccuguacgugaaguacgacggggauccguggaccgacagcgacccccuggcccucuccggcgucauggugagcauggaggagcccgggugguacuccuucggcuuugagaucaaggacaagaagugcgacgugcccugcaucgggaucgagaugguccacgauggcggcaaggagacguggcacagcgcggccaccgccaucuacugccugaugggguccggccagaugcugugggacaccgugaccgggguggacauggcccucuga

SEQ ID NO: 28718 - RNA, 1401 nt, Artificial Sequence
  derived and/or modified CDS sequence (AUadapt) from InfluenzaB__ABL76313__NA
augcugcccaguaccauccagacccucacgcuguuccugaccuccggcggggugcuccugagccuguacgucuccgccagccucuccuaccugcuguauagcgacauccuccugaaguucuccccgaaggagaucaccgcccccaccaugccccugaacugcgcgaacgccaguaacgugcaggccgugaaccgcuccgccacgaagggcgucaccuucccccucccggagcccgaguggaccuacccccggcugucgugccccggguccaccuuucagaaggcccugcucaucagcccgcaccgcuucggcgagacgaaggggaacuccgcgccccugaucauccgggagcccuucaucgccugcggccccaaggaguguaagcacuucgcccugacccacuacgccgcgcagccgggcggguacuacaauggcacccgcgaggaccggaacaagcuccgccaccugaucagcgugaagcuggggaagauccccaccguggagaacuccaucuuccauauggccgccuggagcggcuccgccugccacgacgggcgggaguggacguacaucggcgucgauggccccgacagcaacgcccuccugaagaucaaguacggggaggcguacaccgacaccuaucacuccuacgccaacaacauccugcgcacccaggagucggccugcaauugcaucggcggggacugcuaccucaugaucacggacggcagcgccuccggcaucagugagugccgguuccugaagauccgcgaggggcggaucaucaaggagaucuuccccaccggccgcguggagcacaccgaggagugcacgugcggguuugccuccaacaagaccaucgagugcgcgugccgggacaacagcuauaccgccaagcgcccguucgugaagcugaacgucgagaccgacaccgccgagauccggcucaugugcacggagaccuaccuggauacgccccgccccgacgacggcuccaucaccgggcccugcgagagcaacggcgacaagggcuccgggggcaucaagggcggguuugugcaccagcggauggccucgaagaucgggcgcugguacucccggaccaugagcaagaccaagcgcaugggcaugggccuguacgugaaguacgauggggacccguggaucgacuccgacgcccucacccugagcggcgucaugguguccguggaggagcccgggugguacagcuuuggcuucgagaucaaggacaagaagugcgacguccccugcaucgggaucgagauggugcacgauggcggcaagaccacguggcacuccgcggccaccgccaucuacugccugauggggagcggccagcuccugugggacaccgugaccggggucgacauggcccuguga

SEQ ID NO: 28719 - RNA, 1401 nt, Artificial Sequence
  derived and/or modified CDS sequence (AUadapt) from InfluenzaB__ABL76335__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccugaacugcgcgaaugccagcaacgugcaggccgugaaccgcuccgccaccaagggcgucacccucccccugccggagcccgaguggaccuacccccggcugucgugccccggguccacguuucagaaggcccuccugaucagcccgcaccgcuucggcgagaccaaggggaacuccgcgccccugaucauccgggagcccuucaucgccuguggccccaaggagugcaagcacuucgcccucacccacuacgccgcgcagccgggcggguacuauaacggcacccgcgaggaccggaacaagcugcgccaccugaucagcgugaagcucgggaagauccccacgguggagaauuccaucuuccacauggccgccuggagcggcuccgccugccacgaugggcgggaguggaccuacaucggcgucgacggccccgacagcaacgcccugcugaagaucaaguacggggaggcguauaccgacaccuaccacuccuacgccaacaauauccuccgcacgcaggagucggccugcaacugcaucggcggggacugcuaucugaugaucaccgacggcagcgccuccggcaucagcgagugccgguuccugaagauccgcgaggggcggaucaucaaggagaucuuucccaccggccgcguggagcacaccgaggagugcacgugcggguucgccuccaacaagaccaucgagugcgcgugucgggacaacagcuacaccgccaagcgcccguucgugaagcucaaugucgagaccgacacggccgagauccggcugaugugcaccgagaccuaccuggacacgccccgccccgacgauggcuccaucaccgggcccugcgagagcaacggcgacaagggcuccgggggcaucaagggcggguucgugcaccagcggauggccaguaagaucgggcgcugguacucccggaccaugagcaagaccaagcgcaugggcaugggccucuacgugaaguacgacggggauccguggaucgacuccgacgcccugacccugagcggcgucaugguguccauggaggagcccgggugguacagcuucggcuuugagaucaaggacaagaagugcgacgugcccugcaucgggaucgagaugguccacgauggcggcaagacgaccuggcacuccgcggccaccgccaucuacugccucauggggagcggccagcugcugugggacaccgugacggggguggacauggcccucuga

SEQ ID NO: 28720 - RNA, 1401 nt, Artificial Sequence
  derived and/or modified CDS sequence (AUadapt) from InfluenzaB__ABL76346__NA
augcugcccaguaccauccagacccucacgcuguuccugaccuccggcggggugcuccugagccuguacgucuccgccagccucuccuaccugcuguacagugacauccuccugaaguucuccccgaaggagaucaccacccccacgaugccccugaacugcgccaacgcgagcaacgugcaggccgugaaucgcuccgccaccaagggcgucacccuccugcugcccgagccggaguggaccuacccccggcucagcugccccggguccacguuccagaaggcccugcugaucucgccccaccgcuuuggcgagaccaaggggaacuccgccccgcucaucauccgggagcccuucaucgcgugcggccccaaggagugcaagcacuucgcccugacccacuaugccgcccagcccggcggguacuacaacggcacccgcgaggaccggaacaagcugcgccaccucaucagcgugaagcuggggaagaucccgacgguggagaauuccaucuuccacauggcggccuggagcggcuccgccugccacgacgggcgggaguggaccuauaucggcgucgacggccccgacagcaacgcccugcucaagaucaaguacggggaggccuacaccgacaccuaucacuccuacgcgaacaacauccugcgcacgcaggagucggccugcaacuguaucggcggggacugcuaccugaugaucaccgacggcagcgccuccggcaucagcgagugucgguuccucaagauccgcgaggggcggaucaucaaggagaucuuccccaccggccgcguggagcacaccgaggagugcacgugcggguucgccuccaacaagaccaucgagugugccugccgggacaacucguacaccgcgaagcgccccuucgugaagcugaaugucgagaccgacacggccgagauccggcugaugugcaccgagaccuaccucgacaccccgcgccccgacgacggcuccaucacggggcccugcgagaguaacggcgacaagggcuccgggggcaucaagggcggguucgugcaccagcggauggccagcaagaucgggcgcugguacucccggaccaugucgaagaccaagcgcaugggcaugggccuguaugugaaguacgacggggaccccuggaucgacuccgacgcccugacccucagcggcgucaugguguccauggaggagccggggugguauagcuucggcuucgagaucaaggacaagaagugcgacgugcccugcaucgggaucgagaugguccaugacggcggcaagacgaccuggcacuccgccgcgaccgccaucuacugccugauggggagcggccagcugcucugggacaccgugacggggguggacauggcccuguga

SEQ ID NO: 28721 - RNA, 1401 nt, Artificial Sequence; identical to SEQ ID NO: 28720
  derived and/or modified CDS sequence (AUadapt) from InfluenzaB__ABL76357__NA

SEQ ID NO: 28722 - RNA, 1401 nt, Artificial Sequence
  derived and/or modified CDS sequence (AUadapt) from InfluenzaB__ABL76368__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaaggaguguaagcacuucgcccugacccacuacgccgcgcagcccggcggguacuacaauggcacccgcgaggaccggaacaagcugcgccaccucaucagcgugaagcuggggaagaucccgacgguggagaacuccaucuuccauauggccgccuggucgggcuccgccugccacgacgggaaggaguggaccuacaucggcgucgacggccccgauagcaacgcccugcucaagaucaaguacggggaggcguacaccgacaccuaucacuccuacgccaacaacauccugcggacgcaggagagcgccugcaauugcaucggcgggaacugcuaccugaugaucaccgacggcagcgccuccggcaucagugagugccgcuuccucaagauccgggaggggcgcaucaucaaggagaucuuccccaccggccgggugaagcacaccgaggagugcacguguggguucgccuccaacaagaccaucgagugcgcgugccgcgacaacaguuacaccgccaagcggcccuucgugaagcugaacgucgagaccgacacggccgagauccgccugaugugcaccgagaccuaccucgauaccccgcggcccgacgacggcuccaucacggggcccugcgagagcaacggcgacaagggcuccgggggcaucaagggcggguuugugcaccagcgcauggccagcaagaucgggcggugguacucccgcaccaugucgaagaccaagcggaugggcaugggccuguacgugaaguaugacggggaccccuggaccgacuccggcgcccuggcgcucagcggggucaugguguccauggaggagccgggcugguacagcuuuggguucgagaucaaggacaagaagugcgacgugcccugcaucggcaucgagaugguccacgauggcgggaaggagacguggcacuccgccgccaccgccaucuacugccugaugggcagcgggcagcugcucugggacaccgugaccggcguggacauggcccuguga

SEQ ID NO: 28723 - RNA, 1404 nt, Artificial Sequence
  derived and/or modified CDS sequence (AUadapt) from InfluenzaB__ABL76379__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccucgaacgugcaggccgugaaucgcuccgccaccaagggcgucaccuuccuccugcugcccgagccggaguggaccuacccccggcucagcugccccggguccacguuccagaaggcccugcugaucagcccccaccgcuuuggcgagaccaaggggaacuccgcgccgcucaucauccgggagcccuucaucgccugcggccccaaggagugcaagcacuucgcccugacccauuacgccgcgcagcccggcggguacuacaacggcacccgcggggaccggaacaagcugcgccaccucaucagugugaagcugggcaagaucccgacgguggagaacuccaucuuccacauggccgccuggucgggguccgccugccacgacggcaaggaguggaccuauaucggcgucgacgggcccgacagcaacgcccugcucaagaucaaguacggcgaggcguacaccgauaccuaccacuccuacgccaacaacauccugcggacgcaggagagcgccugcaauugcaucgggggcaacugcuaccugaugaucaccgacggcagcgccuccgggaucucggagugucgcuuccucaagauccgggagggccgcaucaucaaggagaucuuccccaccgggcgggugaagcacaccgaggagugcacgugcggcuucgccuccaauaagaccaucgagugcgcgugccgcgacaacagcuacaccgccaagcggcccuucgugaagcugaaugucgagaccgacacggccgagauccgccugaugugcaccgagaccuaccucgacaccccgcggcccgacgacggguccaucacgggccccugcgagaguaacggcgacaagggguccggcgggaucaagggcggguucgugcaccagcgcauggccagcaagaucggccggugguacucccgcaccaugaguaagaccaagcggaugggcauggggcuguacgugaaguacgacggcgaccccuggaccgacuccgacgcccuggcgcucagcggggucaugguguccauggaggagccgggcugguauagcuucggguucgagaucaaggacaagaagugcgacgugcccugcaucggcaucgagaugguccaugacggcgggaaggagacguggcacuccgccgccaccgccaucuacugccugaugggcagcgggcagcugcucugggacaccgugaccggcguggacauggcccuguga

SEQ ID NO: 28724 - RNA, 1401 nt, Artificial Sequence
  derived and/or modified CDS sequence (AUadapt) from InfluenzaB__ABL76390__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccgcuccagcaccaagggcgucaccuuccuccugcccgagccggaguggaccuacccccggcuguccugccccgggagcacguuucagaaggcccuccugaucucgccccaccgcuucggcgagaccaaggggaacuccgccccgcugaucauccgggagcccuucaucgcgugcggccccaaggaguguaagcacuucgcccucacccacuacgccgcccagcccggcggguacuacaacggcacccgcgaggaucggaacaagcugcgccaccugaucuccgugaagcucgggaagaucccgacgguggagaacagcaucuuccacauggcggccugguccggcagugccugccacgacgggaaggaguggaccuacaucggcgucgacggccccgacuccaaugcccugcugaagaucaaguacggggaggccuacaccgacaccuaccacagcuaugcgaacaacauccuccggacgcaggagagcgccugcaacugcaucggcgggaacuguuaccugaugaucaccgacggcuccgccagcggcaucuccgagugccgcuuccugaagauccgggaggggcgcaucaucaaggagaucuuccccaccggccgggugaagcauaccgaggagugcacgugcggguucgccagcaacaagaccaucgagugcgccugucgcgacaacuccuacaccgcgaagcggcccuucgugaagcucaacgucgagaccgacacggccgagauccgccugauguguaccgagaccuaccuggacaccccgcggcccgacgacggcucgaucacgggguccugcgagagcgauggcgacaagggcuccgggggcaucaagggcggguucgugcaccagcgcauggccagcaagaucgggcggugguacucccgcaccaugagcaagaccaagcggaugggcaugggccucuaugugcgcuacgacggggaccccuggaccgacuccagcgcccuggcccuguccggcgucauggugagcauggaggagcccgggugguauuccuucggcuucgagaucaaggacaagaagugcgacgugccgugcaucgggaucgagaugguccaugacggcggcaaggagacguggcacagcgcggccaccgccaucuacugccucaugggguccggccagcugcugugggacaccgugaccgggguggacauggcccucuga

SEQ ID NO: 28725 - RNA, 1401 nt, Artificial Sequence
  derived and/or modified CDS sequence (AUadapt) from InfluenzaB__ABL76412__NA
augcugcccaguaccauccagacccucacgcuguuccugaccuccggcggggugcuccugagccuguacgucuccgccucgcucuccuaccugcuguacagugacauccuccugaaguucuccccgaccgagaucaccgcccccacgaugccccuggacugcgcgaacgccagcaacgugcaggccgugaaucgcuccgccaccaagggcgucacccuccugauccccgagccggaguggaccuacccccggcugucgugccccggguccacguuccagaaggcccuccugaucagcccccaccgcuuuggcgagaccaaggggaacuccgcgccgcugaucauccgggagcccuucaucgccugcggccccaaggagugcaagcacuucgcccucacccacuauaccgcccagcccggcggguacuacaacggcacgcgcggggaccggaacaagcugcgccaccugaucagcgugaagcucggcaagaucccgaccguggagaauuccaucuuccacauggcggccuggucgggguccgccugccacgacggcaaggaguggaccuauaucggcgucgacgggcccgacagcaacgcccugcugaagaucaaguacggcgaggccuacaccgacacguaucacuccuacgcgaacaacauccuccggacccaggagagcgccugcaacuguaucgggggcaacugcuaccugaugaucaccgacggcucggccuccgggaucagcgagugucgcuuccugaagauccgggagggccgcaucaucaaggagaucuuccccaccgggcgggugaagcacacggaggagugcacgugcggcuucgccuccaacaagaccaucgagugugccugccgcgacaacagcuacaccgcgaagcggcccuucgugaagcucaaugucgagaccgacaccgccgagauccgccugaugugcaccgagaccuaccuggacacgccgcggcccgacgacggguccaucaccggccccugcgagaguaacggcgacaagggguccggcgggaucaagggcggguucgugcaccagcgcauggccagcaagaucggccggugguacucccgcaccaugagcaagaccaagcggaugggcauggggcucuaugugaaguacgacggcgaccccuggacggacuccgacgcccuggcccugucgggggucaugguguccauggaggagccgggcugguauagcuucggguucgagaucaaggacaagaagugcgacgugcccugcaucggcaucgagaugguccaugacggcgggaaggagaccuggcacuccgcggccaccgccaucuacugccucaugggcagcgggcagcugcugugggacaccgugacgggcguggacauggcccucuga

SEQ ID NO: 28726 - RNA, 1401 nt, Artificial Sequence
  derived and/or modified CDS sequence (AUadapt) from InfluenzaB__ABL76423__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaacgugcaggccgugaaucacuccgccaccaagggcgucacccuccugcugcccgagccggaguggaccuacccccgccucagcugccccggguccacguuccagaaggcccugcugaucucgccccaccgguuuggcgagaccaaggggaacuccgcgccgcucaucauccgcgagcccuucaucgccugcggccccaaggagugcaagcacuucgcccugacccacuaugccgcgcagcccggcggguacuacaacggcacccgcggggaccggaacaagcugcggcaccucaucagugugaagcugggcaagaucccgacgguggagaacuccaucuuccacauggccgccuggagcggguccgccugccacgacggcaaggaguggaccuauaucggcgucgacgggcccgacagcaacgcccugcucaagaucaaguacggcgaggcguacaccgacaccuaucacuccuacgccaacaacauccugcgcacgcaggagucggccugcaacuguaucgggggcaacugcuaccugaugaucaccgacggcagcgccuccgggaucagcgagugucgguuccucaagauccgcgagggccggaucaucaaggagaucuuccccaccgggcgcgugaagcacaccgaggagugcacgugcggcuucgccuccaacaagaccaucgagugugcgugccgggacaacucguacaccgccaagcgccccuucgugaagcugaacgucgagaccgauacggccgagauccggcugaugugcaccgagaccuaccucgacaccccgcgccccgacgacggguccaucacgggccccugcgagagcaauggcgacaagggguccggcgggaucaagggcggguucgugcaccagcggauggccagcaagaucggccgcugguacucccggaccaugucgaagaccaagcgcaugggcauggggcuguaugugaaguacgacggcgaccccuggaccgacuccgacgcccuggcguucagcggggucaugguguccauggaggagccgggcugguauagcuucggguucgagaucaaggacaagaagugcgacgugcccugcaucggcaucgagaugguccaugacggcgggaaggagacguggcacuccgccgccaccgccaucuacugccucaugggcagcgggcagcugcugugggacaccgugaccggcguggacauggcccucuga

SEQ ID NO: 28727 - RNA, 1401 nt, Artificial Sequence
  derived and/or modified CDS sequence (AUadapt) from InfluenzaB__ABL76434__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccagcaacgugcaggccgugaaccgcuccgccaccaagggcgucacccuccugcugcccgagccggaguggaccuacccccggcucagcugucccggguccacguuccagaaggcccugcugaucucgccccaccgcuucggcgagaccaaggggaacuccgcgccgcucaucauccgggagcccuuuaucgccugcggccccaaggagugcaagcacuucgcccugacccacuaugccgcgcagcccggcggguacuacaacggcacccgcggggaccggaacaagcugcgccaucucaucagcgugaagcugggcaagaucccgacgguggagaacuccaucuuccacauggccgccuggagcggguccgccugucacgacggcaaggaguggaccuacaucggcgucgacgggcccgacaauaacgcccugcucaagaucaaguacggcgaggcguacaccgacaccuaccauagcuacgccaacaacauccugcggacgcaggaguccgccugcaacuguaucgggggcaacugcuaccugaugaucaccgacggcagcgccagugggaucuccgagugccgcuuccucaagauccgggagggccgcaucaucaaggagaucuuccccaccgggcgggugaagcacaccgaggagugcacguguggcuucgccucgaacaagaccaucgagugcgcgugccgcgauaacuccuacaccgccaagcggcccuucgugaagcugaacgucgagaccgacacggccgagauccgccugauguguaccgagaccuaccucgacaccccgcggcccgacgacgggagcaucacgggccccugugaguccaacggcgacaaggggagcggcgggaucaagggcggguucgugcaccagcgcauggccuccaagaucggccggugguauagccgcaccauguccaagaccaagcggaugggcauggggcuguacgugaaguacgacggcgaccccugggccgauagcgacgcgcuggcccucuccggggucauggugagcauggaggagccgggcugguacuccuucggguuugagauccgcgacaagaagugcgacgugcccugcaucggcaucgagaugguccacgauggcgggaaggagaccuggcacagcgccgccacggccaucuacugccugaugggcuccgggcagcugcucugggacaccgugaccggcguggacauggcgcuguga

SEQ ID NO: 28728 - RNA, 1401 nt, Artificial Sequence
  derived and/or modified CDS sequence (AUadapt) from InfluenzaB__ABL76456__NA
augcugcccaguaccauccagacccucacgcuguuccugaccuccggcggggugcuccugagccuguacgucuccgccagccucuccuaccugcuguauucggacauccuccugaaguucuccccgaccgagaucaccgcccccacgaugccccuggacugcgcgaacgccaguaacgugcaggccgugaaccgcuccgccaccaagggcgucaagcuccugcugcccgagccggaguggaccuacccccggcucagcugccccggguccaccuuccagaaggcccugcugaucaguccccaccgcuucggcgagacgaaggggaacuccgcgccgcucaucauccgggagcccuucaucgccugcggccccaaggagugcaagcauuucgcccugacccacuacgccgcgcagcccggcggguacuacaauggcacccgcggggaccggaacaagcugcgccaccucaucucggugaagcugggcaagaucccgaccguggagaacuccaucuuccauauggccgccuggagcggguccgccugccacgacggcaaggaguggacguacaucggcgucgacgggcccgauaacaacgcccugcucaagaucaaguacggcgaggcguacaccgacaccuaccauagcuacgccaacaacauccugcggacccaggaguccgccugcaacuguaucgggggcaacugcuaccugaugaucacggacggcagcgccagugggguguccgagugccgcuuccucaagauccgggagggccgcaucaucaaggagaucuuccccaccgggcgggugaagcacaccgaggagugcacgugcggcuuugccagcaacaagaccaucgagugcgcgugccgcgacaacuccuauaccgccaagcggcccuucgucaagcugaacguggagaccgacaccgccgagauccgccugaugugcacggagaccuaccucgacaccccgcggcccgaugacgggagcaucaccggccccugcgaguccaacggcgacaaggggaguggcgggaucaagggcggguucgugcaccagcgcauggccuccaagaucggccggugguacucgcgcacgauguccaagaccaagcggaugggcauggggcuguacgucaaguacgauggcgaccccugggccgacagcgacgcgcuggcccucuccggggugauggugagcauggaggagccgggcugguacuccuuuggguucgagaucaaggacaagaagugcgacguccccugcaucggcaucgagauggugcacgauggcgggaaggagaccuggcacagcgccgccaccgccaucuacugccugaugggcuccgggcagcugcucugggacacggugaccggcgucgacauggcgcuguga

SEQ ID NO: 28729 - RNA, 1401 nt, Artificial Sequence
  derived and/or modified CDS sequence (AUadapt) from InfluenzaB__ABL76467__NA
augcugcccaguaccauccagacccucacgcuguuccugaccuccggcggggugcuccugagccuguacgucuccgccagccucuccuaccugcuguauucggacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaaggagugcaagcauuucgcccugacccacuacgccgcgcagcccggcggguacuacaauggcacccgcggggaccggaacaagcugcgccaccucaucucggugaagcugggcaagaucccgacgguggagaacuccaucuuccauauggccgccuggagcggguccgccugccacgacggcaaggaguggaccuacaucggcgucgacgggcccgauaacaacgcccugcucaagaucaaguacggcgaggcguacaccgacaccuaccauagcuacgccaacaacauccugcggacgcaggaguccgccugcaacuguaucgggggcaacugcuaccugaugaucaccgacggcagcgccagugggaucuccgagugccgcuuccucaagauccgggagggccgcaucaucaaggagaucuuccccaccgggcgggugaagcacaccgaggagugcacgugcggcuuugccagcaacaagaccaucgagugcgcgugccgcgacaacuccuauaccgccaagcggcccuucgugaagcugaacgucgagaccgacacggccgagauccgccugaugugcaccgagaccuaccucgacaccccgcggcccgaugacgggagcaucacgggccccugcgaguccaacggcgacaaggggaguggcgggaucaagggcggguucgugcaccagcgcauggccuccaagaucggccggugguacucgcgcaccauguccaagaccaagcggaugggcauggggcuguacgugaaguacgauggcgaccccugggccgacagcgacgcgcuggcccucuccggggucauggugagcauggaggagccgggcugguacuccuuuggguucgagaucaaggacaagaagugcgacgugcccugcaucggcaucgagaugguccacgauggcgggaaggagaccuggcacagcgccgccacggccaucuacugccugaugggcuccgggcagcugcucugggacaccgugaccggcguggacauggcgcuguga

SEQ ID NO: 28730 - RNA, 1401 nt, Artificial Sequence
  derived and/or modified CDS sequence (AUadapt) from InfluenzaB__ABL76478__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccgcuccgccaccaagggcgucaagcuccugcugcccgagccggaguggaccuacccccggcucagcugccccggguccaccuuccagaaggcccugcugaucucgccccaucgcuucggcgagacgaaggggaacuccgcgccgcucaucauccgggagcccuucaucgccugcggccccaaggagugcaagcacuuugcccugacccacuacgccgcgcagcccggcggguacuacaacggcacccgcggggaccggaauaagcugcgccaccucaucagcgugaagcugggcaagaucccgaccguggagaacuccaucuuccacauggccgccuggagcggguccgccugccaugacggcaaggaguggacguacaucggcgucgacgggcccgacaacaacgcccugcucaagaucaaguauggcgaggcguacaccgacaccuaccacucguacgccaauaacauccugcggacccaggaguccgccugcaacugcaucgggggcaacugcuaucugaugaucacggacggcagcgccagcgggguguccgagugccgcuuccucaagauccgggagggccgcaucaucaaggagaucuuccccaccgggcgggugaagcauaccgaggagugcacgugcggcuucgccucgaacaagaccaucgagugcgcgugucgcgacaacuccuacaccgccaagcggcccuucgucaagcugaacguggagaccgacaccgccgagauccgccugaugugcacgaagaccuaucucgacaccccgcggcccgacgacgggagcaucaccggccccugcgaguccaacggcgauaaggggagcggcgggaucaagggcggguucgugcaccagcgcauggccuccaagaucggccggugguacucgcgcacgauguccaagaccaagcggaugggcauggggcuguacgucaaguaugacggcgaccccugggccgacagcgacgcgcuggcccucuccggggugauggugagcauggaggagccgggcugguauuccuucggguucgagaucaaggacaagaagugcgacguccccugcaucggcaucgagauggugcaugacggcgggaaggagaccuggcacagcgccgccaccgccaucuacugccugaugggcuccgggcagcugcucugggacacggugaccggcgucgacauggcgcuguga

SEQ ID NO: 28731 - RNA, 1401 nt, Artificial Sequence
  derived and/or modified CDS sequence (AUadapt) from InfluenzaB__ABL76522__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccagcaacgugcaggccgugaaccgcuccgccaccaagggcgucacccuccugcugcccgagccggaguggaccuacccccggcucagcugucccggguccacguuccagaaggcccugcugaucucgccccaccgcuucggcgagaccaaggggaacuccgcgccgcucaucauccgggagcccuuuaucgccugcggccccaacgagugcaagcacuucgcccugacccauuacgccgcgcagcccggcggguacuacaacggcacccgcggggaccggaauaagcugcgccaccucaucagcgugaagcugggcaagaucccgacgguggagaacuccaucuuccacauggccgccuggagcggguccgccugucacgacggcaaggaguggaccuacaucggcgucgacgggcccgacaauaacgcccugcucaagaucaaguacggcgaggcguacaccgacaccuaccauagcuacgccaacaacauccugcggacgcaggaguccgccugcaauugcaucgggggcaacugcuaccugaugaucaccgacggcagugccagcgggguguccgagugccgcuuccucaagauccgggagggccgcaucaucaaggagaucuuccccaccgggcgggugaagcacaccgaggaguguacgugcggcuucgccucgaacaagaccaucgagugcgcgugucgcgacaacuccuacaccgccaagcggcccuucgucaagcugaacguggagaccgacacggccgagauccgccugauguguaccgagaccuaccucgacaccccgcggcccgacgacgggagcaucacgggccccugugaguccaacggcgacaaggggagcggcgggaucaagggcggguucgugcaccagcgcauggccuccaagaucggccggugguauagccgcaccauguccaagaccgagcggaugggcauggggcuguacgucaaguacgacggcgaccccugggccgauagcgacgcgcuggcccucuccggggugauggugagcauggaggagccgggcugguacuccuucggguuugagaucaaggacaagaagugcgacguccccugcaucggcaucgagauggugcacgauggcgggaaggagaccuggcacagcgccgccacggccaucuacugccugaugggcuccgggcagcugcucugggacaccgugaccggcgucgacauggcgcuguga

SEQ ID NO: 28732 - RNA, 1401 nt, Artificial Sequence
  derived and/or modified CDS sequence (AUadapt) from InfluenzaB__ABL76533__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccucgaacgugcaggccgugaaccgcuccgccaccaagggcgucacccuccugcugcccgagccggaguggaccuacccccggcucagcugccccggguccacguuucagaaggcccugcugaucagcccccaccgcuucggcgagaccaaggggaacuccgcgccgcucaucauccgggagcccuucaucgccuguggccccaacgagugcaagcacuucgcccugacccacuacgccgcgcagcccggcggguauuacaacggcaagcgcggggaccggaacaagcugcgccaccucaucagugugaagcugggcaagaucccgaccguggagaacuccaucuuccacauggccgccuggagcggguccgccugccacgauggcaaggaguggacguacaucggcgucgacgggcccgacaacaacgcccugcucaagaucaaguauggcgaggcguacaccgacaccuaccacucguacgccaauaacauccugcggacccaggaguccgccugcaacugcaucgggggcaacuguuaccugaugaucacggacggcagcgccagcgggguguccgagugccgcuuccucaagauccgggagggccgcaucaucaaggagaucuuucccaccgggcgggugaagcacaccgaggagugcacgugcggcuucgccagcaauaagaccaucgagugcgcgugccgcgacaacuccuacaccgccaagcggcccuucgucaagcugaauguggagaccgacaccgccgagauccgccugaugugcacggagaccuaccucgacaccccgcggcccgacgaugggagcaucaccggccccugcgaguccaacggcgacaaggggucgggcgggaucaagggcggguucgugcaucagcgcauggccuccaagaucggccggugguacagccgcacgauguccaagaccgagcggaugggcauggggcuguacgucaaguacgacggcgaucccugggccgacagcgacgcgcuggcccucuccggggugauggugagcauggaggagccgggcugguacuccuucggguuugagaucaaggacaagaagugcgacguccccugcaucggcaucgagauggugcacgauggcgggaaggagaccuggcacagcgccgccaccgccaucuacugccugaugggcuccgggcagcugcucugggacacggugaccggcgucgacauggcgcuguga

SEQ ID NO: 28733 - RNA, 1401 nt, Artificial Sequence
  derived and/or modified CDS sequence (AUadapt) from InfluenzaB__ABL76544__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccagcaacgugcaggccgugaaccgcuccgccaccaagggcgucacccuccugcugcccgagccggaguggaccuacccccggcucagcugucccggguccacguuccagaaggcccugcugaucucgccccaccgcuucggcgagaccaaggggaacuccgcgccgcucaucauccgggagcccuuuaucgccugcggccccaacgagugcaagcacuucgcccugacccauuacgccgcgcagcccggcggguacuacaacggcacccgcggggagcggaacaagcugcgccaucucaucagcgugaagcugggcaagaucccgacgguggagaacuccaucuuccacauggccgccuggagcggguccgccugucacgacggcaaggaguggaccuacaucggcgucgacgggcccgacaauaacgcccugcucaagaucaaguacggcgaggcguacaccgacaccuaccauagcuacgccaacaacauccugcggacgcaggaguccgccugcaacuguaucgggggcaacugcuaccugaugaucaccgacggcagcgccagugggguguccgagugccgcuuccucaagauccgggagggccgcaucaucaaggagaucuuccccaccgggcgggugaagcacaccgaggagugcacguguggcuucgccucgaacaagaccaucgagugcgcgugccgcgauaacuccuacaccgccaagcggcccuucgucaagcugaacguggagaccgacacggccgagauccgccugauguguaccgagaccuaccucgacaccccgcggcccgacgacgggagcaucacgggccccugugaguccaacggcgacaaggggagcggcgggaucaagggcggguucgugcaccagcgcauggccuccaagaucggccggugguauagccgcaccauguccaagaccgagcggaugggcauggggcuguacgucaaguacgacggcgaccccugggccgauagcgacgcgcuggcccucuccggggugauggugagcauggaggagccgggcugguacuccuucggguuugagaucaaggacaagaagugcgacguccccugcaucggcaucgagauggugcacgauggcgggaaggagaccuggcacagcgccgccacggccaucuacugccugaugggcuccgggcagcugcucugggacaccgugaccggcgucgacauggcgcuguga

SEQ ID NO: 28734 - RNA, 1401 nt, Artificial Sequence; identical to SEQ ID NO: 28732
  derived and/or modified CDS sequence (AUadapt) from InfluenzaB__ABL76566__NA

SEQ ID NO: 28735 - RNA, 1401 nt, Artificial Sequence
  derived and/or modified CDS sequence (AUadapt) from InfluenzaB__ABL76588__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacuacgcgaaugccucgaacgugcaggccgugaaccgcuccgccaccaagggcgucacccuccugcugcccgagccggaguggaccuacccccggcucagcugccccggguccacguuucagaaggcccugcugaucagcccccaccgcuucggcgagaccaaggggaacuccgcgccgcucaucauccgggagcccuucaucgccuguggccccaacgagugcaagcacuucgcccugacccacuacgccgcgcagcccggcggguauuacaacggcacccgcggggaccggaacaagcugcgccaccucaucagugugaagcugggcaagaucccgacgguggagaacuccaucuuccacauggccgccuggagcggguccgccugccacgauggcaaggaguggaccuacaucggcgucgacgggcccgacaacaacgcccugcucaagaucaaguauggcgaggcguacaccgacaccuaccacucguacgccaauaacauccugcggacgcaggaguccgccugcaacugcaucgggggcaacuguuaccugaugaucaccgacggcagcgccagcgggguguccgagugccgcuuccucaagauccgggagggccgcaucaucaaggagaucuuucccaccgggcgggugaagcacaccgaggagugcacgugcggcuucgccagcaauaagaccaucgagugcgcgugccgcgacaacuccuacaccgccaagcggcccuucgucaagcugaauguggagaccgacacggccgagauccgccugaugugcaccgagaccuaccucgacaccccgcggcccgacgaugggagcaucacgggccccugcgaguccaacggcgacaaggggucgggcgggaucaagggcggguucgugcaucagcgcauggccuccaagaucggccggugguacagccgcaccauguccaagaccgagcggaugggcauggggcuguacgucaaguacgacggcgaucccugggccgacagcgacgcgcuggcccucuccggggugauggugagcauggaggagccgggcugguacuccuucggguuugagaucaaggacaagaagugcgacguccccugcaucggcaucgagauggugcacgauggcgggaaggagaccuggcacagcgccgccacggccaucuacugccugaugggcuccgggcagcugcucugggacaccgugaccggcgucgacauggcgcuguga

SEQ ID NO: 28736 - RNA, 1401 nt, Artificial Sequence; identical to SEQ ID NO: 28731
  derived and/or modified CDS sequence (AUadapt) from InfluenzaB__ABL76599__NA

SEQ ID NO: 28737 - RNA, 1401 nt, Artificial Sequence; identical to SEQ ID NO: 28731
  derived and/or modified CDS sequence (AUadapt) from InfluenzaB__ABL76610__NA

SEQ ID NO: 28738 - RNA, 1401 nt, Artificial Sequence
  derived and/or modified CDS sequence (AUadapt) from InfluenzaB__ABL76621__NA
augcugcccaguaccauccagacccucacgcuguuccugaccuccggcggggugcuccugagccuguacgucuccgccagccucuccuaccugcuguauucggacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaaggaguguaagcacuucgcccugacccacuacgccgcgcagcccggcggguacuacaauggcacccgcggggaccggaacaagcugcgccaccucaucucggugaagcugggcaagaucccgacgguggagaacuccaucuuccauauggccgccuggagcggguccgccugccacgacggcaaggaguggaccuacaucggcgucgacgggcccgauaacaacgcccugcucaagaucaaguacggcgaggcguacaccgacaccuaucacagcuacgccaacaacauccugcggacgcaggaguccgccugcaauugcaucgggggcaacugcuaccugaugaucaccgacggcagcgccagugggguguccgagugccgcuuccucaagauccgggagggccgcaucaucaaggagaucuuccccaccgggcgggugaagcacaccgaggagugcacguguggcuucgccagcaacaagaccaucgagugcgcgugccgcgacaauuccuacaccgccaagcggcccuucgucaagcugaacguggagaccgacacggccgagauccgccugaugugcaccgagaccuaccucgauaccccgcggcccgacgacgggagcaucacgggccccugcgaguccaacggcgagaaggggagcggcgggaucaagggcggguuugugcaccagcgcauggccuccaagaucggccggugguacucgcgcaccauguccaagaccaagcggaugggcauggggcuguacgucaaguacgauggcgaccccugggccgacagcgacgcgcuggcccucuccggggugauggugagcauggaggagccgggcugguacuccuuuggguucgagaucaaggacaagaagugcgacauccccugcaucggcaucgagaugguccacgauggcgggaaggagaccuggcacagcgccgccacggccaucuacugccugaugggcuccgggcagcugcucugggacaccgugaccggcguggacauggcgcuguga

SEQ ID NO: 28739 - RNA, 1401 nt, Artificial Sequence
  derived and/or modified CDS sequence (AUadapt) from InfluenzaB__ABL76632__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaacgccaguaacgugcaggccgugaaccgcuccgccacgaagggcgucacccuccugcugcccgagcccgaguggaccuacccgcggcucagcugccccggguccaccuuucagaaggcccugcugaucagcccccaccgcuucggcgagacgaaggggaacuccgcgccccucaucauccgggagccguucaucgccugcggccccaccgaguguaagcacuucgcccugacccacuacgccgcgcagcccggcggguacuacaauggcacccgcgaggaccggaacaagaugcgccaccugaucagcgugaagcucgggaagauccccacgguggagaacuccaucuuucacauggccgccuggagcggcuccgccugccacgacgggaaggaguggaccuacaucggcgucgauggcccggacucgaacgcccugcugaagaucaaguacggggaggcguacaccgauaccuaccacuccuacgccaagaacauccuccggacgcaggagagcgccugcaauugcaucggcggggacugcuaccugaugaucaccgacggccccgccagcggcaucuccgagugucgcuuccugaagauccgggaggggcgcaucaucaaggagaucuuccccaccggccgggugaagcacaccgaggagugcacgugcggguuugccagcaacaagaccaucgagugcgcgugccgcgacaacuccuauaccgccaagcggcccuucgugaagcucaacgucgagaccgacacggccgagauccgccugaugugcaccgagaccuaccuggauaccccgcggcccaacgacggcagcaucacggggcccugcgaguccgacggcgacaagggcagugggggcaucaagggcggguucgugcaccagcgcauggccuccaagaucgggcggugguacagccgcaccauguccaagaccaagcggaugggcaugggccucuacgugaaguacgauggggaccccuggaccgacagcgaggcccuggcgcuguccggcgucauggugagcauggaggagccggggugguacuccuuuggcuucgagaucaaggacaagaagugcgacgugcccugcaucgggaucgagaugguccacgauggcggcaagacgaccuggcacagcgccgccaccgccguguacugccucaugggguccggccagcugcugugggacaccgugacgggggucgacauggcccucuga

SEQ ID NO: 28740 - RNA, 1401 nt, Artificial Sequence
  derived and/or modified CDS sequence (AUadapt) from InfluenzaB__ABL76643__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaacgccaguaacgugcaggccgugaaccgcuccgccacgaagggcgucacccuccugcugcccgagcccgaguggaccuacccgcggcucagcugccccggguccaccuuucagaaggcccugcugaucagcccccaccgcuucggcgagacgaaggggaacuccgcgccccucaucauccgggagccguucaucgccugcggccccaccgaguguaagcacuucgcccugacccacuacgccgcgcagcccggcggguacuacaauggcacccgcgaggaccggaacaagcugcgccaccucaucagcgugaagcuggggaagauccccacgguggagaacuccaucuuucacauggccgccuggagcggcuccgccugccacgacgggaaggaguggaccuacaucggcgucgauggcccggacucgaacgcccugcucaagaucaaguacggggaggcguacaccgauaccuaccacuccuacgccaagaacauccugcggacgcaggagagcgccugcaauugcaucggcggggacugcuaccugaugaucaccgacggccccgccagcggcaucuccgagugucgcuuccucaagauccgggaggggcgcaucaucaaggagaucuuccccaccggccgggugaagcacaccgaggagugcacgugcggguuugccagcaacaagaccaucgagugcgcgugccgcgacaacuccuauaccgccaagcggcccuucgugaagcugaacgucgagaccgacacggccgagauccgccugaugugcaccgagaccuaccucgauaccccgcggcccaacgacggcagcaucacggggcccugcgaguccgacggcgacaagggcagugggggcaucaagggcggguucgugcaccagcgcauggccuccaagaucgggcggugguacagccgcaccauguccaagaccaagcggaugggcaugggccuguacgugaaguacgauggggaccccuggaccgacagcgaggcccuggcgcucuccggcgucauggugagcauggaggagccggggugguacuccuuuggcuucgagaucaaggacaagaagugcgacgugcccugcaucgggaucgagaugguccacgauggcggcaagacgaccuggcacagcgccgccaccgccaucuacugccugaugggguccggccagcugcucugggacaccgugacggggguggacauggcccuguga

SEQ ID NO: 28741 - RNA, 1401 nt, Artificial Sequence
  derived and/or modified CDS sequence (AUadapt) from InfluenzaB__ABL76654__NA
augcugcccaguaccauccagacccucacgcuguuccugaccuccggcggggugcuccugagccuguacgucuccgccagccucuccuaccugcuguacagugacauccuccugaaguucucccagaccgagaucaccgccccgaucaugccccuggacugcgcgaacgccagcaaugugcaggccgugaaccgcuccacgaccaagggcgucacccuccugcugcccgagcccgaguggaccuacccgcggcucagcugccccggguccacguuccagaaggcccugcugaucagcccccaucgcuucggcgagaccaaggggaacuccgcgccccucaucauccgggagccguucaucgccugcggccccaccgagugcaagcacuuugcccugacccacuacgccgcccagcccggcggguacuacaacggcacgcgcgaggaccggaauaagcugcgccaccucaucucggugaagcuggggaagauccccaccguggagaacuccaucuuccacauggcggccuggagcggcuccgccugucacgacgggaaggaguggaccuacaucggcgucgacggcccggacagcaaugcccugcucaagaucaaguacggggaggccuacaccgacacguaccacuccuacgcgaagaauauccugcggacccaggagagcgccugcaacugcaucggcggggacugcuaucugaugaucaccgacggccccgccucgggcaucuccgagugccgcuuccucaagauccgggaggggcgcaucaucaaggagaucuuccccaccggccgggugaagcacacggaggaguguacgugcggguucgccagcaacaagaccaucgagugcgccugccgcgauaacuccuacaccgcgaagcggcccuucgugaagcugaacgucgagaccgacaccgccgagauccgccugaugugcaccgagaccuaucucgacacgccgcggcccaacgacggcagcaucaccgggcccugcgaguccgacggcgauaagggcagcgggggcaucaagggcggguucgugcaccagcgcauggccuccaagaucgggcggugguacucgcgcaccauguccaagaccaagcggaugggcaugggccuguacgugaaguaugacggggaccccuggacggacagcgaggcccuggcccucuccggcgucauggugagcauggaggagccggggugguacuccuuuggcuucgagaucaaggacaagaagugcgacgugcccugcaucgggaucgagaugguccacgauggcggcaagaccaccuggcacagcgcggccaccgccaucuacugccugaugggguccggccagcugcucugggacacggugaccgggguggacauggcccuguga

SEQ ID NO: 28742 - RNA, 1401 nt, Artificial Sequence
  derived and/or modified CDS sequence (AUadapt) from InfluenzaB__ABL76665__NA
augcugcccaguaccauccagacccucacgcuguuccugaccuccggcggggugcuccugagccuguacgucuccgccagccucuccuaccugcuguacagugacauccuccugaaguucucccagaccgagaucaccgccccgaucaugccccuggacugcgcgaacgccucgaaugugcaggccgugaaccgcuccgccacgaagggcgucacccuccugcugcccgagcccgaguggaccuacccgcggcucagcugccccggguccaccuuccagaaggcccugcugaucagcccccaucgcuucggcgagacgaaggggaacuccgcgccccucaucauccgggagccguucaucgccugcggccccaccgagugcaagcacuuugcccugacccacuacgccgcgcagcccggcggguacuacaacggcacccgcgaggaccggaauaagcugcgccaccucaucagcgugaagcuggggaagauccccacgguggagaacuccaucuuccacauggccgccuggagcggcuccgccugucacgacgggaaggaguggaccuacaucggcgucgacggcccggacucgaaugcccugcucaagaucaaguacggggaggcguacaccgacaccuaccacuccuacgccaagaauauccugcggacgcaggagagcgccugcaacugcaucggcggggacugcuaucugaugaucaccgacggccccgccagcggcaucuccgagugccgcuuccucaagauccgggaggggcgcaucaucaaggagaucuuccccaccggccgggugaagcacaccgaggaguguacgugcggguucgccagcaacaagaccaucgagugcgcgugccgcgauaacuccuacaccgccaagcggcccuucgugaagcugaacgucgagaccgacacggccgagauccgccugaugugcaccgagaccuaucucgacaccccgcggcccaacgacggcagcaucacggggcccugcgaguucgauggcgacaagggcuccgggggcaucaagggcggguucgugcaccagcgcauggccucgaagaucgggcggugguacucccgcaccaugagcaagaccaagcggaugggcaugggccuguaugugaaguacgacggggaccccuggaccgacuccgaggcccuggcgcucagcggcgucaugguguccauggaggagccggggugguacaguuucggcuucgagaucaaggacaagaagugcgacgugcccugcaucgggaucgagaugguccaugacggcggcaagacgaccuggcacuccgccgccaccgccaucuacugccugauggggagcggccagcugcucugggacaccgugacggggguggacauggcccuguga

SEQ ID NO: 28743 - RNA, 1401 nt, Artificial Sequence
  derived and/or modified CDS sequence (AUadapt) from InfluenzaB__ABL76676__NA
augcugcccaguaccauccagacccucacgcuguuccugaccuccggcggggugcuccugagccuguacgucuccgccagccucuccuaccugcuguauagcgacauccuccugaaguucucccagaccggcaucaccgccccgaucaugccccuggacugcgcgaaugccagcaacgugcaggccgugaaccgcuccgccacgaagggggucacccuccugcugcccgagcccgaguggaccuacccgcggcucagcugucccggcuccaccuuccagaaggcccugcugaucucgccccaccgcuucggggagacgaagggcaacuccgcgccccucaucauccgggagccguucaucgccuguggccccaaggagugcaagcacuucgcccugacccacuacgccgcgcagcccgggggcuauuacaacgggacccgcgaggaccggaacaagcugcgccaccucaucagugugaagcugggcaagauccccaccguggagaacuccaucuuccacauggccgccuggagcggguccgccugccaugacggccgggaguggacguacaucggcgucgacgggccggacagcaacgcccugcucaagaucaaguauggcgaggcguacaccgacaccuaccacuccuacgccaagaauauccugcgcacccaggagagcgccugcaacugcaucgggggcgacuguuaccugaugaucacggacggccccgccagcgggaucuccgagugccgguuccucaagauccgcgagggccggaucaucaaggagaucuuucccaccgggcgcgugaagcacaccgaggagugcacgugcggcuucgccucgaacaagaccaucgagugugcgugccgggacaacuccuacaccgccaagcgccccuucgugaagcugaaugucgagaccgacaccgccgagauccggcugaugugcacggagaccuaccucgacaccccgcgccccaacgaugggagcaucaccggccccugcgaguccaacggcgacaaggggagcggcgggaucaagggcggguuugugcaccagcggauggccuccaagaucggccgcugguacagccggacgauguccaagaccaagcgcaugggcauggggcuguacgugaaguacgacggcgaucccuggaccgacagcgaggcccuggcgcucuccggggucauggugagcauggaggagccgggcugguacuccuucggguuugagaucaaggacaagaagugcgacgugcccugcaucggcaucgagaugguccacgauggcgggaagaccacguggcacagcgccgccaccgccaucuacugccugaugggcuccgggcagcugcucugggacaccgugaccggcguggacauggcccuguga

SEQ ID NO: 28744 - RNA, 1401 nt, Artificial Sequence
  derived and/or modified CDS sequence (AUadapt) from InfluenzaB__ABL76687__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaacgccaguaacgugcaggccgugaaccgcuccgccacgaagggcgucacccuccugcugcccgagcccgaguggaccuacccgcggcucagcugccccggguccaccuuucagaaggcccugcugaucucgccccaccgcuucggcgagacgaaggggaacuccgcgccccucaucauccgggagccguucaucgccugcggccccaccgaguguaagcacuucgcccugacccacuacgccgcgcagcccggcggguacuacaauggcacccgcgaggaccggaacaagcugcgccaccucaucagcgugaagcuggggaagauccccacgguggagaacuccaucuuucacauggccgccuggagcggcuccgccugccacgacgggaaggaguggaccuacaucggcgucgauggcccggacagcaacgcccugcucaagaucaaguacggggaggcguacaccgauaccuaccacuccuacgccaagaacauccugcggacgcaggagagcgccugcaauugcaucggcggggacugcuaccugaugaucaccgacggccccgccagcggcaucuccgagugucgcuuccucaagauccgggaggggcgcaucaucaaggagaucuuccccaccggccgggugaagcacaccgaggagugcacgugcggguuugccucgaacaagaccaucgagugcgcgugccgcgacaacuccuauaccgccaagcggcccuucgugaagcugaacgucgagaccgacacggccgagauccgccugaugugcaccgagaccuaccucgauaccccgcggcccaacgacggcagcaucacggggcccugcgaguucgacggcgauaagggcuccgggggcaucaagggcggguucgugcaccagcgcauggccagcaagaucgggcggugguacucccgcaccaugagcaagaccaagcggaugggcaugggccuguacgugaaguaugacggggaccccuggaccgacuccgaggcccuggcgcucagcggcgucauggugccgauggaggagcccgggugguacuccuuuggcuucgagaucaaggacaagaagugcgacgugcccugcaucgggaucgagaugguccacgauggcggcaagacgaccuggcacagcgccgccaccgccaucuacugccugaugggguccggccagcugcucugggacaccgugacggggguggacauggcccuguga

SEQ ID NO: 28745 - RNA, 1401 nt, Artificial Sequence; identical to SEQ ID NO: 28673
  derived and/or modified CDS sequence (AUadapt) from InfluenzaB__ABL76698__NA

SEQ ID NO: 28746 - RNA, 1401 nt, Artificial Sequence
  derived and/or modified CDS sequence (AUadapt) from InfluenzaB__ABL76720__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccagcaacgugcaggccgugaaccgcuccgccaccaagggcgucacccuccugcugcccgagccggaguggaccuacccccggcucagcugccccggguccacguuucagaaggcccugcugaucucgccccaccgcuucggcgagaccaaggggaacuccgcgccgcucaucauccgggagcccuucaucgccuguggccccaacgagugcaagcacuucgcccugacccacuacgccgcgcagcccggcggguauuacaacggcacccgcggggaccggaacaagcugcgccaccucaucagugugaagcugggcaagaucccgacgguggagaacuccaucuuccacauggccgccuggagcggguccgccugccacgauggcaaggaguggaccuacaucggcgucgacgggcccgacaacaacgcccugcucaagaucaaguauggcgaggcguacaccgacaccuaccacagcuacgccaauaagauccugcggacgcaggaguccgccugcaacugcaucgggggcaacugcuaucugaugaucaccgacggcagcgccagcgggguguccgagugccgcuuccucaagauccgggagggccgcaucaucaaggagaucuuccccaccgggcgggugaagcauaccgaggagugcacgugcggcuucgccucgaacaagaccaucgagugugcgugccgcgacaacuccuacaccgccaagcggcccuucgucaagcugaacguggagaccgauacggccgagauccgccugaugugcaccgacaccuaccucgacaccccgcggcccgacgaugggagcaucacgggccccugcgaguccaacggcgacaaggggagcggcgggaucaagggcggguucgugcaucagcgcauggccuccaagaucggccggugguacagccgcaccauguccaagaccgagcggaugggcauggggcuguacgucaaguacgacggcgaucccugggccgacagcgacgcgcuggccuucuccggggugauggugagcaugaaggagccgggcugguacuccuuuggguucgagaucaaggacaagaagugcgacguccccugcaucggcaucgagauggugcaugacggcgggaaggagaccuggcgcagcgccgccacggccaucuacugccucaugggcuccgggcagcugcugugggacaccgugaccggcgucgacauggcgcucuga

SEQ ID NO: 28747 - RNA, 1401 nt, Artificial Sequence
  derived and/or modified CDS sequence (AUadapt) from InfluenzaB__ABL76731__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcacgccgugaaccgcuccgccaccaagggcgucacccuccugcugcccgagccggaguggaccuacccccggcucagcugccccggguccacguuccagaaggcccugcugaucagcccccaucgcuucggcgagaccaaggggaacuccgcgccgcucaucauccgggagcccuucaucgccugcggccccaacgagugcaagcauuucgccaucacccacuacgccgcgcagcccggcggguacuacaacggcacccgcggggaccggaauaagcugcgccaccugaucucggugaagcucggcaagaucccgacgguggagaacuccaucuuccacauggccgccuggagcggguccgccugucacgacggcaaggaguggaccuacaucggcgucgacgggcccgacaacaaugcccugcugaagaucaaguacggcgaggcguacaccgacaccuaccacagcuacgccaauaacauccuccggacgcaggaguccgccugcaacugcaucgggggcaacugcuaucugaugaucaccgacggcagcgccucggggguguccgagugccgcuuccugaagauccgggagggccgcaucaucaaggagaucuuccccaccgggcgggugaagcacaccgaggaguguacgugcggcuucgccagcaacaagaccaucgagugcgcgugccgcgauaacuccuacaccgccaagcggcccuucgucaagcucaacguggagaccgacacggccgagauccgccugaugugcaccgauaccuaccuggacaccccgcggcccgacgacgggagcaucacgggccccugcgaguccaacggcgauaaggggagcggcgggaucaagggcggguucgugcaccagcgcauggccuccaagaucggccggugguacucgcgcaccauguccaagaccgagcggaugggcauggggcucuacgucaaguaugacggcgaccccugggccgacagcgacgcgcuggccuucuccggggugauggugagcaugaaggagccgggcugguauuccuucggguucgagaucaaggacaagaagugcgacguccccugcaucggcaucgagauggugcaugacggcgggaaggagaccuggcacagcgccgccacggccaucuacugccugaugggcuccgggcagcuccugugggacaccgugaccggcgucgacauggcgcuguga

SEQ ID NO: 28748 - RNA, 1401 nt, Artificial Sequence
  derived and/or modified CDS sequence (AUadapt) from InfluenzaB__ABL76742__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaacgaguguaagcacuucgcccugacccacuacgccgcgcagcccggcggguacuacaauggcacccgcggggaccggaacaagcugcgccaccucaucagcgugaagcugggcaagaucccgacgguggagaacuccaucuuccauauggccgccuggagcggguccgccugccacgacggcaaggaguggaccuacaucggcgucgacgggcccgauaacaacgcccugcucaagaucaaguacggcgaggcguacaccgacaccuaccauucguacgccaacaagauccugcggacgcaggaguccgccugcaacugcaucgggggcaauugcuaccugaugaucaccgacggcagcgccagcgggguguccgagugucgcuuccucaagauccgggagggccgcaucaucaaggagaucuuccccaccgggcgggugaagcacaccgaggagugcacgugcggcuucgccaguaacaagaccaucgagugcgcgugccgcgacaacuccuacaccgccaagcggcccuuugucaagcugaacguggagaccgacacggccgagauccgccugaugugcaccgacaccuaccucgacaccccgcggcccgaugacgggagcaucacgggccccugcgaguccaacggcgacaaggggucgggcgggaucaagggcggguuugugcaccagcgcauggccuccaagaucggccggugguacagccgcaccauguccaagaccgagcggaugggcauggggcuguacgucaaguacgacggcgaucccugggccgacagcgacgcgcuggccuucuccggggugauggugagcaugaaggagccgggcugguacuccuuuggguucgagaucaaggacaagaagugcgacguccccugcaucggcaucgagauggugcacgauggcgggaaggagaccuggcacagcgccgccacggccaucuacugccucaugggcuccgggcagcugcugugggacaccgugaccggcgucgacauggcgcucuga

SEQ ID NO: 28749 - RNA, 1401 nt, Artificial Sequence
  derived and/or modified CDS sequence (AUadapt) from InfluenzaB__ABL76753__NA
augcugcccaguaccauccagacccucacgcuguuccugaccuccggcggggugcuccugagccuguacgucuccgccagccucuccuaccugcuguauucggacauccuccugaaguucucccagaccgagaucaccgccccgaucaugccccuggacugcgcgaacgccaguaacgugcaggccgugaaccgcuccgccacgaagggcgucacccuccugcugcccgagcccgaguggaccuacccgcggcucagcugccccggguccaccuuccagaaggcccugcugaucaguccccaccgcuucggcgagacgaccgggaacuccgcgccccucaucauccgggagccguucaucgccugcggccccaaggaguguaagcacuucgcccugacccacuacgccgcgcagcccggcggguacuacaauggcacccgcgaggaccggaacaagcugcgccaccucaucucggugaagcuggggaagauccccacgguggagaacuccaucuuccauauggccgccuggagcggcuccgccugccacgacgggcgggaguggaccuacaucggcgucgauggcccggacaacaacgcccugcucaagaucaaguacggggaggcguacaccgacaccuaucacagcuacgccaagaacauccugcgcacgcaggaguccgccugcaacuguaucggcggggacugcuaccugaugaucaccgacggccccgccagcggcaucagugagugccgguuccucaagauccgcgaggggcggaucaucaaggagaucuuccccaccggccgcgugaagcacaccgaggagugcacgugcggguuugccuccaacaagaccaucgagugcgcgugccgggacaacagcuauaccgccaagcgccccuucgugaagcugaacgucgagaccgacacggccgagauccggcugaugugcaccgagaccuaccucgauaccccgcgccccaacgacggcuccaucacggggcccugcgagagcaacggcgacaagggcuccgggggcaucaagggcggguuugugcaccagcggauggccagcaagaucgggcgcugguacucccggaccaugucgaagaccaagcgcaugggcaugggccuguacgugaaguacgauggggaccccuggaccgacuccgaggcccuggcgcucagcggcgucaugguguccauggaggagccggggugguacagcuuuggcuucgagaucaaggacaagaagugcgacgugcccugcaucgggaucgagaugguccacgauggcggcaagacgaccuggcacuccgccgccaccgccaucuacugccugauggggagcggccagcugcucugggacaccgugacggggguggacauggcccuguga

SEQ ID NO: 28750 - RNA, 1401 nt, Artificial Sequence; identical to SEQ ID NO: 28719
  derived and/or modified CDS sequence (AUadapt) from InfluenzaB__ABL76764__NA

SEQ ID NO: 28751 - RNA, 1401 nt, Artificial Sequence; identical to SEQ ID NO: 28719
  derived and/or modified CDS sequence (AUadapt) from InfluenzaB__ABL76775__NA

SEQ ID NO: 28752 - RNA, 1401 nt, Artificial Sequence
  derived and/or modified CDS sequence (AUadapt) from InfluenzaB__ABL76797__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccgcuccgccaccaagggcgucacccuccugcugcccgagccggaguggaccuacccccggcucagcugccccggguccacguuccagaaggcccugcugaucucgccccaucgcuucggcgagaccaaggggaacuccgcgccgcucaucauccgggagcccuucaucgccugcggccccaaggagugcaagcacuuugcccugacccacuacgccgcgcagcccggcggguacuacaacggcacccgcgaggaccggaauaagcugcgccaccucaucagcgugaagcuggggaagaucccgacgguggagaacuccaucuuccacauggccgccuggagcggcuccgccugccaugacgggaaggaguggaccuacaucggcgucgacggccccgacagcaacgcccugcucaagaucaaguauggggaggcguacaccgacaccuaccacuccuacgccaacaauauccugcggacgcaggagucggccugcaacugcaucggcgggaacugcuaucugaugaucaccgacggcagcgccuccggcaucagcgagugccgcuuccucaagauccgggaggggcgcaucaucaaggagaucuuccccaccggccggguggagcauaccgaggagugcacgugcggguucgccuccaacaagaccaucgagugcgcgugccgcgauaacucguacaccgccaagcggcccuucgugaagcugaacgucgagaccgacacggccgagauccgccugaugugcaccgagaccuaucucgacaccccgcggcccgacgacggcuccaucacggggcccugcgagagcaacggcgauaagggcuccgggggcaucaagggcggguucgugcaccagcgcauggccagcaagaucgggcggugguacucccgcaccaugucgaagaccaagcggaugggcaugggccuguacgugaaguaugacggggaccccuggaccgacuccgacgcccuggcgcucagcggcgucaugguguccauggaggagccggggugguacaguuucggcuucgagaucaaggacaagaagugcgacgugcccugcaucgggaucgagaugguccaugacggcggcaaggagacguggcacuccgccgccaccgccaucuacugccugauggggagcggccagcugcucugggacaccgugaccggggugaacauggcccuguga

SEQ ID NO: 28753 - RNA, 1401 nt, Artificial Sequence
  derived and/or modified CDS sequence (AUadapt) from InfluenzaB__ABL76819__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccgcuccgccaccaagggcgucacccuccugcugcccgagccggaguggaccuacccccggcucagcugccccggguccacguuccagaaggcccugcugaucucgccccaucgcuucggcgagaccaaggggaacuccgcgccgcucaucauccgggagcccuucaucgccugcggccccaaggagugcaagcacuuugcccugacccacuacgccgcgcagcccggcggguacuacaacggcacccgcgaggaccggaauaagcugcgccaccucaucagcgugaagcuggggaagaucccgacgguggagaacuccaucuuccacauggccgccuggagcggcuccgccugccaugacgggaaggaguggaccuacaucggcgucgacggccccgacagcaacgcccugcucaagaucaaguauggggaggcguacaccgacaccuaccacuccuacgccaacaauauccugcggacgcaggagucggccugcaacugcaucggcgggaacugcuaucugaugaucaccgacggcagcgccuccggcaucagcgagugccgcuuccucaagauccgggaggggcgcaucaucaaggagaucuuccccaccggccgggugaagcauaccgaggagugcacgugcggguucgccuccaacaagaccaucgagugcgcgugccgcgauaacucguacaccgccaagcggcccuucgugaagcugaacgucgagaccgacacggccgagauccgccugaugugcaccgagaccuaucucgacaccccgcggcccgacgacggcuccaucacggggcccugcgagagcaacggcgauaagggcuccgggggcaucaagggcggguucgugcaccagcgcauggccagcaagaucgggcggugguacucccgcaccaugucgaagaccaagcggaugggcaugggccuguacgugaaguaugacggggaccccuggaccgacuccgacgcccuggcgcucagcggcgucaugguguccauggaggagccggggugguacaguuucggcuucgagaucaaggacaagaagugcgacgugcccugcaucgggaucgagaugguccaugacggcggcaaggagacguggcacuccgccgccaccgccaucuacugccugauggggagcggccagcugcucugggacaccgugaccgggguggacauggcccuguga

SEQ ID NO: 28754 - RNA, 1401 nt, Artificial Sequence
  derived and/or modified CDS sequence (AUadapt) from InfluenzaB__ABL76830__NA
augcugcccaguaccauccagacccucacgcuguuccugaccuccggcggggugcuccugagccuguacgucuccgccagccucuccuaccugcuguacagugacauccuccugaaguucuccccgaccaagaucaccgcccccacgaugccccuggacugcgcgaacgccagcaaugugcaggccgugaaccgcuccgccaccaagggcgucacccuccugcugcccgagccggaguggaccuacccccggcucagcugccccggguccacguuccagaaggcccugcugaucucgccccaucgcuucggcgagaccaaggggaacuccgcgccgcucaucauccgggagcccuucaucgccugcggccccaaggagugcaagcacuuugcccugacccacuacgccgcgcagcccggcggguacuacaacggcacccgcggggaccggaauaagcugcgccaccucaucagcgugaagcugggcaagaucccgacgguggagaacuccaucuuccacauggccgccuggagcggguccgccugccaugacggcaaggaguggaccuacaucggcgucgacgggcccgacaacaacgcccugcucaagaucaaguauggcgaggcguacaccgacaccuaccacucguacgccaauaacauccugcggacgcaggaguccgccugcaacugcaucgggggcaacugcuaucugaugaucaccgacggcagcgccagcgggguguccgagugccgcuuccucaagauccgggagggccgcaucaucaaggagaucuuccccaccgggcgggugaagcauaccgaggagugcacgugcggcuucgccucgaacaagaccaucgagugcgcgugucgcgacaacuccuacaccgccaagcggcccuucgucaagcugaacguggagaccgacacggccgagauccgccugaugugcaccaagaccuaucucgacaccccgcggcccgacgacgggagcaucacgggccccugcgaguccaacggcgauaaggggagcggcgggaucaagggcggguucgugcaccagcgcauggccuccaagaucggccggugguacucgcgcaccauguccaagaccaagcggaugggcauggggcuguacgucaaguaugacggcgaccccugggccgacagcgacgcgcuggcccucuccggggugauggugagcauggaggagccgggcugguauuccuucggguucgagaucaaggacaagaagugcgacguccccugcaucggcaucgagauggugcaugacggcgggaaggagaccuggcacagcgccgccacggccaucuacugccugaugggcuccgggcagcugcucugggacaccgugaccggcgucgacauggcgcuguga

SEQ ID NO: 28755 - RNA, 1401 nt, Artificial Sequence
  derived and/or modified CDS sequence (AUadapt) from InfluenzaB__ABL76852__NA
augcugcccaguaccauccagacccucacgcuguuccugaccuccggcggggugcuccugagccuguacgucuccgccucgcucuccuaccugcuguacagugacauccuccugaaguucuccccgaccgagaucaccgcccccacgaugccccuggacugcgcgaacgccagcaacgugcaggccgugaaucgcuccgccaccaagggcgucacccuccugcugcccgagccggaguggaccuacccccggcucucgugccccggguccacguuccagaaggcccugcugaucagcccccaccgcuuuggcgagaccaaggggaacuccgcgccgcucaucauccgggagcccuucaucgccugcggccccaaggagugcaagcacuucgcccugacccacuaugccgcgcagcccggcggguacuacaacggcacccgcgaggaccggaacaagcugcgccaccucaucagcgugaagcuggggaagaucccgacgguggagaauuccaucuuccacauggccgccuggucgggcuccgccugccacgacgggaaggaguggaccuauaucggcgucgacggccccgacagcaacgcccugcucaagaucaaguacggggaggcguacaccgacaccuaucacuccuacgccaacaacauccugcggacgcaggagagcgccugcaacuguaucggcgggaacugcuaccugaugaucaccgacggcucggccuccggcaucagcgagugucgcuuccucaagauccgggaggggcgcaucaucaaggagaucuuccccaccggccgggugaagcacaccgaggagugcacgugcggguucgccuccaacaagaccaucgagugugcgugccgcgacaacagcuacaccgccaagcggcccuucgugaagcugaaugucgagaccgacacggccgagauccgccugaugugcaccgagaccuaccucgacaccccgcggcccgacgacggcuccaucacggggcccugcgagaguaacggcgacaagggcuccgggggcaucaagggcggguucgugcaccagcgcauggagagcaagaucgggcggugguacucccgcaccaugagcaagaccaagcggaugggcaugggccuguaugugaaguacgacggggaccccuggaccgacuccgacgcccuggcccucucgggcgucaugguguccaucgaggagccggggugguauagcuucggcuucgagaucaaggacaagaagugcgacgugcccugcaucgggaucgagaugguccaugacggcggcaaggagacguggcacuccgcggccaccgccaucuacugccugauggggagcggccagcugcucugggacaccgugaccgggguggacauggcccuguga

SEQ ID NO: 28756 - RNA, 1401 nt, Artificial Sequence
  derived and/or modified CDS sequence (AUadapt) from InfluenzaB__ABL76863__NA
augcugcccaguaccauccagacccucacgcuguuccugaccuccggcggggugcuccugagccuguacgucuccgccucgcucuccuaccugcuguacagugacauccuccugaaguucuccccgaccgagaucaccgcccccacgaugccccuggacugcgcgaacgccagcaacgugcaggccgugaaucgcuccgccaccaagggcgucacccuccugcugcccgagccggaguggaccuacccccggcucucgugccccggguccacguuccagaaggcccugcugaucagcccccaccgcuuuggcgagaccaaggggaacuccgcgccgcucaucauccgggagcccuucaucgccugcggccccaaggagugcaagcacuucgcccugacccacuaugccgcgcagcccggcggguacuacaacggcacccgcgaggaccggaacaagcugcgccaccucaucagcgugaagcuggggaagaucccgacgguggagaauuccaucuuccacauggccgccuggucgggcuccgccugccacgacgggaaggaguggaccuauaucggcgucgacggccccgacagcaacgcccugcucaagaucaaguacggggaggcguacaccgacaccuaucacuccuacgccaacaacauccugcggacgcaggagagcgccugcaacuguaucggcgggaacugcuaccugaugaucaccgacggcucggccuccggcaucagcgagugucgcuuccucaagauccgggaggggcgcaucaucaaggagaucuuccccaccggccgggugaagcacaccgaggagugcacgugcggguucgccuccaacaagaccaucgagugugcgugccgcgacaacagcuacaccgccaagcggcccuucgugaagcugaaugucgagaccgacacggccgagauccgccugaugugcaccgagaccuaccucgacaccccgcggcccgacgacggcuccaucacggggcccugcgagaguaacggcgacaagggcuccgggggcaucaagggcggguucgugcaccagcgcauggccagcaagaucgggcggugguacucccgcaccaugagcaagaccaagcggaugggcaugggccuguaugugaaguacgacggggaccccuggaccgacuccgacgcccuggcgcucucgggcgucaugguguccauggaggagccggggugguauagcuucggcuucgagaucaaggacaagaagugcgacgugcccugcaucgggaucgagaugguccaugacggcggcaaggagacguggcacuccgccgccaccgccaucuacugccugauggggagcggccagcugcucugggacaccgugaccgggguggacauggccauguga

SEQ ID NO: 28757 - RNA, 1401 nt, Artificial Sequence
  derived and/or modified CDS sequence (AUadapt) from InfluenzaB__ABL76874__NA
augcugcccaguaccauccagacccucacgcuguuccugaccuccggcggggugcuccugagccuguacgucuccgccucgcucuccuaccugcuguacagcgauauccuccugaaguucuccccgaccgagaucaccgcccccacgaugccccuggacugcgcgaacgccagcaacgugcaggccgugaacuccagugccaccaagggcgucacccuccugcugcccgagccggaguggaccuacccccgccucuccugccccgggagcacguuccagaaggcccugcugaucagcccccaccgguucggcgagaccaaggggaauuccgcgccgcucaucauccgcgagcccuucaucgccugcggccccaaggagugcaagcacuucgcccugacccacuacgccgcgcagcccggcggguauuacaacggcacccgcggggaccggaacaagcugcggcaccucaucuccgugaagcugggcaagaucccgacgguggagaacucgaucuuucacauggccgccugguccgggagcgccugccacgacggcaaggaguggaccuacaucggcgucgacgggcccgauuccaacgcccugcucaagaucaaguacggcgaggcguacaccgacaccuaccacagcuaugccaacaacauccugcgcacgcaggagucggccugcaacugcaucgggggcaacugcuaucugaugaucaccgacggcuccgccagcgggaucuccgagugccgguuccucaagauccgcgagggccggaucaucaaggagaucuuccccaccgggcgcgugaagcacaccgaggagugcacguguggcuucgccagcaacaagaccaucgagugcgcgugccgggacaacuccuauaccgccaagcgccccuucgugaagcugaacgucgagaccgacacggccgagaucaagcugaugugcaccgagaccuaccucgacaccccgcggcccgacgaugggucgaucacgggccccugcgaguccaacggcgacaaggggagcggcgggaucaagggcggguucgugcaccagcgcauggccuccaagaucggccggugguauagccgcaccauguccaagaccaagcggaugggcauggggcuguacgugaaguacgacggcgaccccuggaccgacucggaugcccuggcgcucuccggggucauggugagcauggaggagccgggcugguacuccuucggguucgagaucaaggacaagaagugcgacgugcccuguaucggcaucgagaugguccacgacggcgggaaggagacguggcacagcgccgccaccgccaucuacugccugaugggcuccgggcagcugcucugggacaccgugaccggcguggacauggcccuguga

SEQ ID NO: 28758 - RNA, 1401 nt, Artificial Sequence
  derived and/or modified CDS sequence (AUadapt) from InfluenzaB__ABL76885__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgacgaugccccuggacuacgcgaacgccaguaacgugcaggccgugaaccgcuccgccaccaagggcgucacccuccugcugcccgagcccgaguggaccuacccgcggcucagcugccccggguccacguuccagaaggcccugcugaucaguccccaccgcuucggcgagaccaaggggaacuccgcgccccucaucauccgggagccguucaucgccugcggccccaaggaguguaagcacuucgcccugacccacuacgccgcgcagcccggcggguacuacaauggcacccgcgaggaccggaacaagcugcgccaccucaucagcgugaagcuggggaagauccccacgguggagaacuccaucuuccauauggccgccuggucgggcuccgccugccacgacgggcgggaguggaccuacaucggcgucgauggcccggacagcaacgcccugcucaagaucaaguacggggaggcguacaccgacaccuaucacuccuacgccaagaacauccugcgcacgcaggagagcgccugcaacuguaucggcggggacugcuaccugaugaucaccgacggcagcgccuccggcaucagugagugccgguuccucaagauccgcgaggggcggaucaucaaggagaucuuccccaccggccgcgugaagcacaccgaggagugcacgugcggguuugccuccaacaagaccaucgagugcgcgugccgggacaacagcuauaccgccaagcgccccuucgugaagcugaacgucgagaccgacacggccgagauccggcugaugugcaccgagaccuaccucgauacgccccgcccggacgacggcuccaucaccgggcccugcgagagcaacggcgacaagggcuccgggggcaucaagggcggguuugugcaccagcggauggccagcaagaucgggcgcugguacucccggaccaugucgaagaccaagcgcaugggcaugggccuguacgugaaguacgauggggaccccuggaccgacuccgaggcccuggcgcucagcggcgucaugguguccauggaggagcccgggugguacagcuuuggcuucgagaucaaggacaagaagugcgacgugccgugcaucgggaucgagaugguccacgauggcggcaagacgaccuggcacuccgccgccaccgccaucuacugccugauggggagcggccagcugcucugggacaccgugacggggguggacauggcccuguga

SEQ ID NO: 28759 - RNA, 1401 nt, Artificial Sequence
  derived and/or modified CDS sequence (AUadapt) from InfluenzaB__ABL76896__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgacgaugccccuggacugcgcgaaugccagcaacgugcaggccgugaaccgcuccgccaccaagggcgucacccuccugcugcccgagcccgaguggauguacccgcggcucagcugucccggguccaccuuccagaaggcccugcugaucucgccccaccgcuucggcgagacgaaggggaacuccgcgccccucaucauccgggagccguucaucgccuguggccccaaggagugcaagcacuucgcccugacccacuacgccgcgcagcccggcggguauuacaacggcacccgcgaggaccggaacaagcugcgccaccucaucagugugaagcuggggaagauccccaccguggagaacuccaucuuccacauggccgccuggagcggcuccgccugccacgaugggcgggaguggacguacaucggcgucgacggcccggacagcaacgcccugcucaagaucaaguauggggaggcguacaccgacaccuaccacuccuacgccaagaauauccugcgcacccaggagagcgccugcaacugcaucggcggggacugcuaucugaugaucacggacggcagcgccuccggcaucagcgagugccgguuccucaagauccgcgaggggcggaucaucaaggagaucuuucccaccggccgcgugaagcacaccgaggagugcacgugcggguucgccuccaacaagaccaucgagugugcgugccgggacaacucguacaccgccaagcgccccuucgugaagcugaaugucgagaccgacaccgccgagauccggcugaugugcacggagaccuaccucgacacgccccgcccggacgauggcuccaucaccgggcccugcgagagcaacggcgacaagggcuccgggggcaucaagggcggguucgugcaucagcggauggccagcaagaucgggcgcugguacucccggaccaugagcaagaccaagcgcaugggcaugggccuguacgugaaguacgacggggaucccuggaccgacuccgaggcccuggcgcucagcggcgucaugguguccauggaggagcccgggugguacagcuucggcuuugagaucaaggacaagaagugcgacgugccgugcaucgggaucgagaugguccacgauggcggcaagaccacguggcacuccgccgccaccgccaucuacugccugauggggagcggccagcugcucugggacgccgugaccgggguggacauggcgcuguga

SEQ ID NO: 28760 - RNA, 1401 nt, Artificial Sequence
  derived and/or modified CDS sequence (AUadapt) from InfluenzaB__ABL76918__NA
augcugcccaguaccauccagacccucacgcuguuccugaccuccggcggggugcuccugagccuguacgucuccgccagccucuccuaccugcuguauucggacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaacgaguguaagcacuucgcccugacccacuacgccgcgcagcccggcggguacuacaauggcacccgcggggaccggaacaagcugcgccaccucaucucggugaagcugggcaagaucccgacgguggagaacuccaucuuccauauggccgccuggagcggguccgccugccacgacggcaaggaguggaccuacaucggcgucgaugggcccgacaacaacgcccugcucaagaucaaguacggcgaggcguacaccgacaccuaucacagcuacgccaacaacauccugcggacgcaggaguccgccugcaauugcaucgggggcaacugcuaccugaugaucaccgacggcagcgccagugggguguccgagugccgcuuccucaagauccgggagggccgcaucaucaaggagaucuuccccaccgggcgggugaagcacaccgaggagugcacgugcggcuuugccagcaacaagaccaucgagugcgcgugccgcgacaacuccuauaccgccaagcggcccuucgucaagcugaacguggagaccgacacggccgagauccgccugaugugcaccgagaccuaccucgauaccccgcggcccgacgacgggagcaucacgggccccugcgaguccaacggcgacaaggggaguggcgggaucaagggcggguucgugcaccagcgcauggccuccaagaucggccggugguacucgcgcaccauguccaagaccgagcggaugggcauggggcuguacgucaaguacgauggcgaccccugggccgacagcgacgcgcuggcccucaucggggugaugguguccauggaggagccgggcugguacagcuuuggguucgagaucaaggacaagaagugcgacguccccugcaucggcaucgagauggugcacgauggcgggaaggagaccuggcacuccgccgccacggccaucuacugccugaugggcagcgggcagcugcucugggacaccgugaccggcgucaacauggcgcuguga

SEQ ID NO: 28761 - RNA, 1401 nt, Artificial Sequence
  derived and/or modified CDS sequence (AUadapt) from InfluenzaB__ABL76962__NA
augcugcccaguaccauccagacccucacgcuguuccugaccuccggcggggugcuccugagccuguacgucuccgcccuccugucguaccugcucuacuccgacauccugcugaaguucagcccgaccaagaucaucgcccccaccaugucccucgauugcgcgaacgccucgaacgugcaggccgugaaccacuccgccacggaggagaugaccuuccugcugcccgagcccgaguggaccuacccgcgccucagcugucagggcuccaccuuccagaaggcccugcugaucucgccccaccgguucggggaggcgaagggcaacuccgcgccccucaucauccgcgagcccuucaucgccugcgggccgaaggagugcaagcacuucgcccugacgcauuacgccgcccagcccggcggcuacuacaacgggacccgggaggaccgcaacaagcugcggcaccucaucagcgucaaccugggcaagauccccaccguggagaauuccaucuuccacauggccgccuggucgggguccgccugccacgacggccgcgaguggaccuacaucgggguggacggccccgacagcaaugcgcugaucaagaucaaguacggcgaggccuacacggacaccuaccacuccuacgccaacaacauccuccggacccaggagagcgccuguaacugcaucgggggcgacugcuaccugaugaucaccgacgggucggccuccggcaucagcaagugccgcuuucugaagauccgggagggccgcaucaucaaggagaucuucccgacggggcgggucgagcacaccgaggagugcacgugcggcuucgcguccaacaagaccaucgagugcgccugccgcgacaacaguuacaccgccaagcggcccuucgugaagcucaacguggagaccgacaccgccgagauccgccugaugugcaccgagacguaccuggacacgccccggcccgacgacggguccaucaccggcccgugugagagcaacggggacaagggcuccggcgggaucaagggcggguucguccaccagcgcauggccucgaagaucggccggugguacucccgcaccaugagcaagaccaagcggauggggauggagcucuacgugaaguacgauggcgaccccuggaccgacuccgacgcgcuggcccccucgggcgugauggucuccauggaggagcccgggugguacagcuucggcuucgagaucaaggacaagaagugugacgugccgugcaucgggaucgagauggugcacgacggcgggaagaagaccuggcacuccgccgccaccgccaucuacugccugaugggcagcggccagcuccugugggacacggucaccgggguggacauggcgcuguga

SEQ ID NO: 28762 - RNA, 1401 nt, Artificial Sequence; identical to SEQ ID NO: 28692
  derived and/or modified CDS sequence (AUadapt) from InfluenzaB__ABL76973__NA

SEQ ID NO: 28763 - RNA, 1401 nt, Artificial Sequence
  derived and/or modified CDS sequence (AUadapt) from InfluenzaB__ABL76984__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgacgaugccccuggacugcgcgaaugccagcaacgugcaggccgugaaccucuccgccaccaagggcgucacccugcugcuccccgagcccgaguggaccuacccgcgccugagcugccccggguccacguuucagaaggcccugcucaucucgccccaccgguucggcgagaccaaggggaacuccgcgccccugaucauccgcgagccguucaucgccuguggccccaaggagugcaagcacuucgcccugacccacuacgccgcgcagcccggcggguacuauaacggcacccgggaggaccgcaacaagcuccggcaccugaucagcgugaagcuggggaagauccccacgguggagaauuccaucuuccacauggccgccuggagcggcuccgccugccacgaugggcgcgaguggaccuacaucggcgucgacggcccggacagcaacgcccuccugaagaucaaguacggggaggcguauaccgacaccuaccacuccuacgccaacaauauccugcggacgcaggagagcgccugcaacugcaucggcgggaacugcuaucucaugaucaccgacggcagcgccuccggcaucagcgagugccgcuuccugaagauccgggaggggcgcaucaucaaggagaucuuucccaccggccggguggagcacaccgaggagugcacgugcggguucgccuccaacaagaccaucgagugcgcgugucgcgacaacucguacaccgccaagcggcccuucgugaagcugaaugucgagaccgacacggccgagauccgccucaugugcaccgagaccuaccuggacacgccccggccggacgauggcuccaucaccgggcccugcgagagcaacggcgacaagggcuccgggggcaucaagggcggguucgugcaccagcgcauggccaguaagaucgggcggugguacucccgcaccaugagcaagaccaagcggaugggcaugggccuguacgugaaguacgacggggaucccuggaccgacuccgacgcccucgcgcugagcggcgucaugguguccauggaggagcccgggugguacagcuucggcuuugagaucaaggacaagaagugcgacgugccgugcaucgggaucgagaugguccacgauggcggcaagcgcacguggcacuccgccgccaccgccaucuacugccugauggggagcggccagcuccugugggacaccgugaccgggguggacauggcccuguga

SEQ ID NO: 28764 - RNA, 1401 nt, Artificial Sequence; identical to SEQ ID NO: 28719
  derived and/or modified CDS sequence (AUadapt) from InfluenzaB__ABL77006__NA

SEQ ID NO: 28765 - RNA, 1401 nt, Artificial Sequence; identical to SEQ ID NO: 28763
  derived and/or modified CDS sequence (AUadapt) from InfluenzaB__ABL77017__NA

SEQ ID NO: 28766 - RNA, 1401 nt, Artificial Sequence
  derived and/or modified CDS sequence (AUadapt) from InfluenzaB__ABL77028__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaaggagugcaagcauuucgcccugacccacuacgccgcgcagcccggcggguacuacaauggcacccgcgaggaccggaacaagcugcgccaccucaucagcgugaagcuggggaagaucccgacgguggagaacuccaucuuccauauggccgccuggucgggcuccgccugccacgacgggaaggaguggaccuacaucggcgucgacggccccgauagcaacgcccugcucaagaucaaguacggggaggcguacaccgacaccuaccauuccuacgccaacaacauccugcggacgcaggagagcgccugcaacuguaucggcgggaacugcuaccugaugaucaccgacggcagcgccuccggcaucagugagugccgcuuccucaagauccgggaggggcgcaucaucaaggagaucuuccccaccggccggguggagcacaccgaggagugcacgugcggguuugccuccaacaagaccaucgagugcgcgugccgcgacaacagcuauaccgccaagcggcccuucgugaagcugaacgucgagaccgacacggccgagauccgccugaugugcaccgagaccuaccucgacaccccgcggcccgaugacggcuccaucacggggcccugcgagagcaacggcgacaagggcuccgggggcaucaagggcggguuugugcaccagcgcauggccagcaagaucgggcggugguacucccgcaccaugucgaagaccaagcggaugggcaugggccuguacgugaaguacgauggggaccccuggaccgacuccgacgcccuggcgcucagcggcgucaugguguccauggaggagccggggugguacagcuuuggcuucgagaucaaggacaagaagugcgacgugcccugcaucgggaucgagaugguccacgauggcggcaaggagacguggcacuccgccgccaccgccaucuacugccugauggggagcggccagcugcucugggacaccgugaccgggguggacauggcccuguga

SEQ ID NO: 28767 - RNA, 1401 nt, Artificial Sequence
  derived and/or modified CDS sequence (AUadapt) from InfluenzaB__ABL77039__NA
augcugcccaguaccauccagacccucacgcuguuccugaccuccggcggggugcuccugagccuguacgucuccgccagccucuccuaccugcuguauagcgacauccuccugaaguucuccccgaccgagaccacggcccccaccaugccccuggacugcgcgaacgccaguaacgugcaggccgugaacugcuccgccaccaagggcgucacccuccugcugcccgagccggaguggacguacccccgccucagcugccccggguccaccuuucagaaggcccugcugaucagcccccaccgguucggcgagaccaaggggaacuccgcgccgcucaucauccgcgagcccuucaucgccugcggccccaaggaguguaagcacuucgcccugacccacuacgccgcgcagcccggcggguacuacaauggcacgcgggaggaccgcaacaagcugcggcaccucaucagcgugaagcuggggaagaucccgaccguggagaacuccaucuuccauauggccgccuggucgggcuccgccugccacgacgggaaggaguggaccuacaucggcgucgauggccccgacagcaacgcccugcucaagaucaaguacggggaggcguacaccgacacguaucacuccuacgccaacaacauccugcgcacccaggagagcgccugcaauugcaucggcgggaacugcuaccugaugaucaccgacggcagcgccuccggcaucagugagugccgguuccucaagauccgcgaggggcggaucaucaaggagaucuuccccaccggccgcguggagcacacggaggagugcacgugcggguuugccuccaacaagaccaucgagugcgcgugccgggacaacagcuauaccgccaagcgccccuucgugaagcugaacgucgagaccgacaccgccgagauccggcugaugugcaccgagaccuaccucgauacgccgcgccccgacgacggcuccaucaccgggcccugcgagagcaacggcgacaagggcuccgggggcaucaagggcggguuugugcaccagcggauggccagcaagaucgggcgcugguacucccggaccaugucgaagaccaagcgcaugggcaugggccuguacgugaaguacgauggggaccccuggacggacuccgacgcccuggcgcucagcggcgucaugguguccauggaggagccggggugguacagcuuuggcuucgagaucaaggacaagaagugcgacgugcccugcaucgggaucgagaugguccacgauggcggcaaggagaccuggcacuccgccgccaccgccaucuacugccugauggggagcggccagcugcucugggacaccgugacggggguggacauggcccuguga

SEQ ID NO: 28768 - RNA, 1401 nt, Artificial Sequence
  derived and/or modified CDS sequence (AUadapt) from InfluenzaB__ABL77050__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccgcgaugccccuggacugcgccaacgccaguaacgugcaggccgugaaccgcuccgccacgaagggcgucacccuccugcugcccgagccggaguggaccuacccccggcucagcugccccggguccaccuuccagaaggcgcugcugaucaguccccaccgcuucggcgagacgaaggggaacuccgccccgcucaucauccgggagcccuucaucgccugcggccccaaggagugcaagcauuucgcccugacccacuacgcggcccagcccggcggguacuacaauggcacccgcgaggaccggaacaagcugcgccaccucaucagcgugaagcuggggaagaucccgaccguggagaacuccaucuuccauauggccgccuggucgggcuccgccugccacgacgggaaggaguggacguacaucggcgucgacggccccgauagcaacgcgcugcucaagaucaaguacggggaggccuacaccgacaccuaccauuccuacgccaacaacauccugcggacccaggagagcgccugcaacuguaucggcgggaacugcuaccugaugaucacggacggcagcgccuccggcaucagugagugccgcuuccucaagauccgggaggggcgcaucaucaaggagaucuuccccaccggccgggugaagcacaccgaggagugcacgugcggguuugcguccaacaagaccaucgagugcgccugccgcgacaacagcuauaccgccaagcggcccuucgugaagcugaacgucgagaccgacaccgccgagauccgccugaugugcacggagaccuaccucgacaccccgcggcccgaugacggcuccaucaccgggcccugcgagagcaacggcgacaagggcuccgggggcaucaagggcggguuugugcaccagcgcauggccagcaagaucgggcggugguacucccgcacgaugucgaagaccaagcggaugggcaugggccuguacgugaaguacgauggggaccccuggaccgacuccgacgcgcuggcccucagcggcgucaugguguccauggaggagccggggugguacagcuuuggcuucgagaucaaggacaagaagugcgacgugcccugcaucgggaucgagaugguccacgauggcggcaaggagaccuggcacuccgccgccacggccaucuacugccugauggggagcggccagcugcucugggacaccgugaccgggguggacauggcgcuguga

SEQ ID NO: 28769 - RNA, 1401 nt, Artificial Sequence
  derived and/or modified CDS sequence (AUadapt) from InfluenzaB__ABL77072__NA
augcugcccaguaccauccagacccucacgcuguuccugaccuccggcggggugcuccugucgcuguacgucuccgcccuccugagcuaccugcucuacuccgacauccugcugaaguucucgccgaccaagaucaucgcccccaccacgucccucgacagcgcgaaugccuccaacuuccaggccgugaaccacucggccaccaaggagaugaccuuccugcugcccgagcccgaguggaccuacccgcgccucuccugccagggcagcacguuccagaaggcccugcugaucucgccccaccgguuuggggaggcgaagggcaacuccgcgccccucaucauccgcgagcccuucaucgccugcgggccgaaggagugcaagcacuucgcccugacccacuacgccgcccagcccggcggcuacuacaacgggacccgggaggaucgcaacaagcugcggcaccucaucuccgugaaccugggcaagauccccaccgucgagaacagcaucuuccacauggccgccugguccgggucggccugccacgacggccgcgaguggacguacaucgggguggauggccccgacuccaacgcgcugaucaagaucaaguacggcgaggccuacaccgacaccuaccacagcuacgccaacaacauccuccggacccaggagucggccuguaacugcaucgggggcgacugcuaccugaugaucacggacggguccgccagcggcaucuccaagugccgcuuccugaagauccgggagggccgcaucaucaaggagaucuucccgaccgggcggguggagcacaccgaggaguguacgugcggcuucgcgucgaacaagaccaucgagugcgccugccgcgacaacuccuacaccgccaagcggcccuucgucaagcucaacguggagaccgacaccgccgagauccgccugauguguacggagaccuaccuggacacgccccggcccgacgacgggagcaucaccggcccgugcgaguccaacggggacaagggcucgggcgggaucaagggcggguucgugcaccagcgcauggccuccaagaucggccggugguauagccgcaccauguccaagaccaagcggauggggauggagcucuacgucaaguacgacggcgaccccuggaccgacucggacgcgcuggcccccuccggcgugauggugagcaucaaggaguccgggugguacucguucggcuuugagaucaaggacaagaagugcgacguccccugcaucgggaucgagauggugcacgacggcgggaagaccacguggcacuccgccgccaccgccaucuacugccugaugggcagcggccagcuccugugggacaccgugaccggggucgacauggcgcuguga

SEQ ID NO: 28770 - RNA, 1401 nt, Artificial Sequence; identical to SEQ ID NO: 28697
  derived and/or modified CDS sequence (AUadapt) from InfluenzaB__ABL77083__NA

SEQ ID NO: 28771 - RNA, 1401 nt, Artificial Sequence; identical to SEQ ID NO: 28697
  derived and/or modified CDS sequence (AUadapt) from InfluenzaB__ABL77094__NA

SEQ ID NO: 28772 - RNA, 1401 nt, Artificial Sequence
  derived and/or modified CDS sequence (AUadapt) from InfluenzaB__ABL77105__NA
augcugcccaguaccauccagacccucacgcuguuccugaccuccggcggggugcuccugagccuguacgucuccgccagccucuccuaccugcuguauagcgacauccuccugaaguucuccagcaccgagaucaccgccccgacgaugccccuggacugcgcgaaugccuccaacgugcaggccgugaaccgcucggccaccgagggcgucacccuccugcugcccgagcccgaguggaccuacccgcggcucuccugccccgggagcacguuucagaaggcccugcugaucagcccccaccgcuucggcgagaccaaggggaacuccgcgccccucaucauccgggagccguucaucgccugcggccccaaggaguguaagcacuucgcccugacccacuacgccgcgcagcccggcggguacuauaacggcacccgcgaggaccggaacaagcugcgccaccucaucuccgugaagcuggggaagauccccacgguggagaacagcaucuuucacauggccgccugguccggcagcgccugccacgacgggaaggaguggaccuacaucggcgucgauggcccggacuccaacgcccugcucaagaucaaguacggggaggcguacaccgacaccuaccauucguacgccaacaacauccugcggacgcaggagagcgccugcaauugcaucggcgggaacugcuaccugaugaucaccgacggcuccgccaguggcaucuccgagugccgcuuccucaagauccgggaggggcgcaucaucaaggagaucuuccccaccggccggguggagcacaccgaggagugcacgugcggguuugccagcaacaagaccaucgagugcgcgugccgcgacaacuccuauaccgccaagcggcccuucgugaagcugaacgucgagaccgacacggccgagauccgccugaugugcaccgagaccuaccucgacacgccccggccggaugacggcagcaucaccgggcccugcgaguccaacggcgacaagggcagugggggcaucaagggcggguucgugcaccagcgcauggccuccaagaucgggcggugguacagccgcaccauguccaagaccaagcggaugggcaugggccuguacgugaaguacgauggggaccccuggaccgacagcgacgcccuggcgcucuccggcgucauggugagcauggaggagcccgggugguacuccuuuggcuucgagaucaaggacaagaagugcgacgugccgugcaucgggaucgagaugguccacgauggcggcaaggagacguggcacagcgccgccaccgccaucuacugccugaugggguccggccagcugcucugggacaccgugaccgggguggacauggcccuguga

SEQ ID NO: 28773 - RNA, 1401 nt, Artificial Sequence; identical to SEQ ID NO: 28697
  derived and/or modified CDS sequence (AUadapt) from InfluenzaB__ABL77127__NA

SEQ ID NO: 28774 - RNA, 1401 nt, Artificial Sequence
  derived and/or modified CDS sequence (AUadapt) from InfluenzaB__ABL77138__NA
augcugcccaguaccauccagacccucacgcuguuccugaccuccggcggggugcuccugagccuguacgucuccgcccuccugucguaccugcucuacuccgacauccugcugaaguucagcccgaccaagaucaucgcccccaccacgucccucgacagugcgaacgccuccaacuuccaggccgugaaccacagcgccaccaaggagaugaccuuccugcugcccgagcccgaguggaccuacccgcgccucuccugccagggcucgacguuucagaaggcccugcugaucagcccccaccgguucggggaggcgaagggcaacuccgcgccccucaucauccgcgagcccuucaucgccugcgggccgaaggagugcaagcacuucgcccugacccacuacgccgcccagcccggcggcuauuacaacgggacccgggaggaccgcaacaagcugcggcaccucaucuccgugaaccugggcaagauccccaccgucgagaacucgaucuuccacauggccgccugguccgggagugccugccacgacggccgcgaguggacguacaucgggguggacggccccgacuccaacgcgcugaucaagaucaaguacggcgaggccuacaccgacaccuaucacagcuacgccaacaacauccuccggacccaggagucggccugcaacugcaucgggggcgacugcuaucugaugaucacggacggguccgccagcggcaucuccaagugccgcuuccugaagauccgggagggccgcaucaucaaggagaucuucccgaccgggcggguggagcacaccgaggagugcacgugcggcuucgcgucgaauaagaccaucgagugcgccugccgcgacaacuccuacaccgccaagcggcccuucgucaagcucaacguggagaccgacaccgccgagauccgccugaugugcacggagaccuaccuggauacgccccggcccgacgacgggagcaucaccggcccgugcgaguccaacggggacaagggcucgggcgggaucaagggcggguucgugcaccagcgcauggccuccaagaucggccggugguacagccgcaccauguccaagaccaagcggauggggauggagcucuaugucaaguacgacggcgaccccuggaccgacucggacgcgcuggcccccuccggcgugauggugagcaucgaggagcccgggugguacuccuucggcuucgagaucaaggauaagaagugcgacgucccgugcaucgggaucgagauggugcacgacggcgggaagaccacgugguacagcgccgccaccgccaucuacugccugaugggcuccggccagcuccugugggacaccgugaccggggucgacauggcgcuguga

SEQ ID NO: 28775 - RNA, 1401 nt, Artificial Sequence; identical to SEQ ID NO: 28697
  derived and/or modified CDS sequence (AUadapt) from InfluenzaB__ABL77149__NA

SEQ ID NO: 28776 - RNA, 1401 nt, Artificial Sequence
  derived and/or modified CDS sequence (AUadapt) from InfluenzaB__ABL77160__NA
augcugcccaguaccauccagacccucacgcuguuccugaccuccggcggggugcuccugagccuguacgucuccgccagccucuccuaccugcuguauagcgacauccuccugaaguucucccagaccaagaucaccgccccgacgaugccccuggacugcgcgaacgccaguaacgugcaggccgugaaccgcuccgccaccaagggcgucacccuccugcugcccgagcccgaguggaccuacccgcggcucagcugccccggguccacguuccagaaggcccugcugaucaguccccaccgcuucggcgagaccaaggggaacuccgcgccccucaucauccgggagccguucaucgccugcggccccaaggaguguaagcacuucgcccugacccacuacgccgcgcagcccggcggguacuacaauggcacccgcgaggaccggaacaagcugcgccaccucaucagcgugaagcuggggaagauccccacgguggagaacuccaucuuccauauggccgccuggucgggcuccgccugccacgacgggcgggaguggaccuacaucggcgucgauggcccggacagcaacgcccugcucaagaucaaguacggggaggcguacaccgacaccuaucacuccuacgccaagaacauccugcgcacgcaggagagcgccugcaacuguaucggcggggacugcuaccugaugaucaccgacggcagcgccuccggcaucagugagugccgguuccucaagauccgcgaggggcggaucaucaaggagaucuuccccaccggccgcgugaagcacaccgaggagugcacgugcggguuugccuccaacaagaccaucgagugcgcgugccgggacaacagcuauaccgccaagcgccccuucgugaagcugaacgucgagaccgacacggccgagauccggcugaugugcaccgagaccuaccucgauacgccccgcccgaacgacggcuccaucaccgggcccugcgagagcgacggcgaccggggcuccgggggcaucaagggcggguuugugcaccagcgcauggagagcaagaucgggcggugguacucccgcaccaugucgaagaccaagcggaugggcaugggccuguacgugaaguacgauggggaccccuggaccgacuccgaggcccuggcccucagcggcgucaugguguccauggaggagcccgggugguacagcuuuggcuucgagaucaaggacaagaagugcgacgugccgugcaucgggaucgagaugguccacgauggcggcaagacgaccuggcacuccgcggccaccaccaucuacugccugauggggagcggccagcugcucugggacacggugaccgggguggacauggcccuguga

SEQ ID NO: 28777 - RNA, 1401 nt, Artificial Sequence; identical to SEQ ID NO: 28729
  derived and/or modified CDS sequence (AUadapt) from InfluenzaB__ABL77171__NA

SEQ ID NO: 28778 - RNA, 1401 nt, Artificial Sequence
  derived and/or modified CDS sequence (AUadapt) from InfluenzaB__ABL77182__NA
augcugcccaguaccauccagacccucacgcuguuccugaccuccggcggggugcuccugagccuguacgucuccgcccuccugucguaccugcucuacuccgacauccugcugaaguucagcccgaccaagaucaucgcccccaccacgucccucgauucggcgaacgccuccaacuuccaggccgugaaccacagcgccaccaaggagaugaccuuccugcugcccgagcccgaguggaccuacccgcgccucuccugucagggcucgacguuccagaaggcccugcugaucagcccccaccgguucggggaggcgaagggcaacuccgcgccccucaucauccgcgagcccuucaucgccugcgggccgaaggagugcaagcacuuugcccugacccacuacgccgcccagcccggcggcuacuacaacgggacccgggaggaccgcaacaagcugcggcaccucaucuccgugaaccugggcaagauccccaccgucgagaauucgaucuuccacauggccgccugguccgggagcgccugccacgacggccgcgaguggacguacaucgggguggacggccccgacuccaaugcgcugaucaagaucaaguacggcgaggccuacaccgacaccuaccacagcuacgccaacaacauccuccggacccaggagagugccugcaacugcaucgggggcgacugcuaccugaugaucacggacggguccgccagcggcaucuccaagugccgcuuucugaagauccgggagggccgcaucgugaaggagaucuucccgaccgggcgggucgagcacaccgaggagugcacgugcggcuucgcgucgaacaagaccaucgagugcgccugccgcgacaauuccuacaccgccaagcggcccuucgugaagcucaacguggagaccgacaccgccgagauccgccugaugugcacggagaccuaccuggacacgccccggcccgacgacgggaguaucaccggcccgugcgaguccaacggggacaagggcucgggcgggaucaagggcggguucguccaccagcgcauggccuccaagaucggccggugguacagccgcaccauguccaagaccaagcggauggggauggagcucuacgugaaguacgauggcgaccccuggaccgacucggacgcgcuggcccccuccggcgugauggucagcaucgaggagcccgggugguacuccuucggcuucgagaucaaggacaagaagugugacgugccgugcaucgggaucgagauggugcacgacggcgggaagaccacguggcacagcgccgccaccgccaucuacugccugaugggcuccggccagcuccugugggacaccaucaccggggucgacauggcgcuguga

SEQ ID NO: 28779 - RNA, 1401 nt, Artificial Sequence; identical to SEQ ID NO: 28704
  derived and/or modified CDS sequence (AUadapt) from InfluenzaB__ABL77193__NA

SEQ ID NO: 28780 - RNA, 1401 nt, Artificial Sequence
  derived and/or modified CDS sequence (AUadapt) from InfluenzaB__ABL77204__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccagcaacgugcaggccgugaaccgcuccgccaccaagggcgucacccuccugauccccgagccggaguggaccuacccccggcugucgugccccggguccacguuucagaaggcccuccugaucagcccccaccgcuucggcgagaccaaggggaacuccgcgccgcugaucauccgggagcccuucaucgccuguggccccaaggagugcaagcacuucgcccucacccacuacgccgcgcagcccggcggguacuauaacggcacccgcggggaccggaacaagcugcgccaccugaucagcgugaagcucggcaagaucccgacgguggagaauuccaucuuccacauggccgccuggagcggguccgccugccacgauggcaaggaguggaccuacaucggcgucgacgggcccgacaacagcgcccugcugaagaucaaguacggcgaggcguauaccgacaccuaccacuccuacgccaacaauauccuccggacgcaggagucggccugcaacugcaucgggggcaacugcuaucugaugaucaccgacggcagcgccuccggggugagcgagugccgcuuccugaagauccgggagggccgcaucaucaaggagaucuuucccaccgggcgggugaagcacaccgaggagugcacgugcggcuucgccuccaacaagaccaucgagugcgcgugucgcgacaacagcuacaccgccaagcggcccuucgucaagcucaauguggagaccgacacggccgagauccgccugaugugcaccgagaccuaccuggacaccccgcggcccgacgauggguccaucacgggccccugcgagagcaacggcgacaagggguccggcgggaucaagggcggguucgugcaccagcgcauggccaguaagaucggccggugguacucccgcaccaugagcaagaccaagcggaugggcauggggcucuacgucaaguacgacggcgaucccugggccgacuccgacgcgcuggcccugagcggggugaugguguccauggaggagccgggcugguacagcuucggguuugagaucaaggacaagaagugcgacguccccugcaucggcaucgagauggugcacgauggcgggaaggagaccuggcacuccgccgccacggccaucuacugccucaugggcagcgggcagcugcugugggacaccgugaccggcgucgacauggcgcucuga

SEQ ID NO: 28781 - RNA, 1401 nt, Artificial Sequence
  derived and/or modified CDS sequence (AUadapt) from InfluenzaB__ABL77215__NA
augcugcccaguaccauccagacccucacgcuguuccugaccuccggcggggugcuccugagccuguacgucuccgccagccucuccuaccugcuguacagugacauccuccugaaguucccguccaccgagaucaccgcccccacgaugccccuggacugcgcgaacgccagcaacgugcaggccgugaaucgcuccgccaccaagggcgucacccuccugcugcccgagccggaguggaccuacccccggcucagcugccccggguccacguuccagaaggcccugcugaucucgccccaccgcuucggcgagaccaaggggaauuccgcgccgcucaucauccgggagcccuucaucgccugcggccccaaggagugcaagcacuucgcccugacccacuaugccgcgcagcccggcggguacuacaacggcacccgcggggaccggaacaagcugcgccaccucaucagcgugaagcugggcaagaucccgacgguggagaauuccaucuuccacauggccgccuggagcggguccgccugccacgacggcaaggaguggaccuacaucggcgucgaugggcccgacaacaacgcccugcucaagaucaaguacggcgaggcguacaccgacaccuaucacucguacgccaacaacauccugcggacgcaggaguccgccugcaacuguaucgggggcaacugcuaccugaugaucaccgacggcagcgccagcgggguguccgagugccgcuuucucaagauccgggagggccgcaucaucaaggagaucuuccccaccgggcggaucaagcacaccgaggagugcacgugcggcuucgccucgaauaagaccaucgagugcgcgugccgcgacaacuccuacaccgccaagcggcccuucgugaagcugaacgucgagaccgauacggccgagauccgccugaugugcaccgagaccuaccucgacaccccgcggcccgacgacgggagcaucacgggccccugcgaguccaauggcgacaaggggagcggcgggaucaagggcggguucgugcaccagcgcauggccuccaagaucggccggugguacucgcgcaccauguccaagaccaagcggaugggcauggggcuguaugugaaguacgacggcgaccccugggccgacagcgacgcgcuggccuucuccggggucauggugaguauggaggagccgggcugguacuccuucggguucgagaucaaggacaagaagugcgacgugcccugcaucggcaucgagaugguccaugacggcgggaaggagaccuggcacagcgccgccacggccaucuacugccucaugggcuccgggcagcugcugugggacaccgugaccggcgugaacauggcgcucuga

SEQ ID NO: 28782 - RNA, 1401 nt, Artificial Sequence; identical to SEQ ID NO: 28740
  derived and/or modified CDS sequence (AUadapt) from InfluenzaB__ABL77226__NA

SEQ ID NO: 28783 - RNA, 1401 nt, Artificial Sequence
  derived and/or modified CDS sequence (AUadapt) from InfluenzaB__ABL77237__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaacgaguguaagcacuucgcccugacccacuacgccgcgcagcccggcggguacuacaauggcacccgcggggaccggaacaagcugcgccaccucaucagcgugaagcugggcaagaucccgacgguggagaacuccaucuuccauauggccgccuggagcggguccgccugccacgacggcaaggaguggaccuacaucggcgucgacgggcccgauaacaacgcccugcucaagaucaaguacggcgaggcguacaccgacaccuaccauucguacgccaacaacauccugcggacgcaggaguccgccugcaacuguaucgggggcaacugcuaccugaugaucaccgacggcagcgccagcgggguguccgagugucgcuuccucaagauccgggagggccgcaucaucaaggagaucuuccccaccgggcgggugaagcacaccgaggagugcacgugcggcuucgccaguaacaagaccaucgagugcgcgugccgcgacaacuccuacaccgccaagcggcccuuugucaagcugaacguggagaccgacacggccgagauccgccugaugugcaccgacaccuaccucgacaccccgcggcccgaugacgggagcaucacgggccccugcgaguccaacggcgacaaggggucgggcgggaucaagggcggguuugugcaccagcgcauggccuccaagaucggccggugguacagccgcaccauguccaagaccgagcggaugggcauggggcuguacgucaaguacgacggcgaucccugggccgacagcgacgcgcuggccuucuccggggugauggugagcaugaaggagccgggcugguacuccuuuggguucgagaucaaggacaagaagugcgacguccccugcaucggcaucgagauggugcacgauggcgggaaggagaccuggcacagcgccgccacggccaucuacugccucaugggcuccgggcagcugcugugggacaccgugaccggcgucgacauggcgcucuga

SEQ ID NO: 28784 - RNA, 1401 nt, Artificial Sequence; identical to SEQ ID NO: 28685
  derived and/or modified CDS sequence (AUadapt) from InfluenzaB__ABL77248__NA

SEQ ID NO: 28785 - RNA, 1401 nt, Artificial Sequence; identical to SEQ ID NO: 28689
  derived and/or modified CDS sequence (AUadapt) from InfluenzaB__ABL77259__NA

SEQ ID NO: 28786 - RNA, 1401 nt, Artificial Sequence
  derived and/or modified CDS sequence (AUadapt) from InfluenzaB__ABL77270__NA
augcugcccaguaccauccagacccucacgcuguuccugaccuccggcggggugcuccugagccuguacgucuccgccagccucuccuaucugcuguacagcgacauccuccugaaguucuccccgaccgagaucaccgcccccacgaugccccuggacugugcgaacgccagcaacgugcaggccgugaaccgcuccgccaccaagggcaugacccuccugcugcccgagccggaguggaccuacccccggcucaguugccccggguccacguuccagaaggcccugcugaucucgccccaccgcuuuggcgagacccgggggaacuccgcgccgcucaucauccgcgagcccuucaucgccugcggccccaaggagugcaagcacuuugcccugacccacuacgccgcgcagcccggcggguacuacaacggcacccgggaggaucgcaacaagcugcggcaccucaucagcgucaagcuggggaagaucccgacgguggagaacuccaucuuccauauggccgccuggagcggcuccgccugccacgacgggcgcgaguggaccuauaucggcguggacggccccgacagcaacgcccugaucaagaucaaguacggggaggcguauaccgacaccuaccacuccuacgccaacaauauccuccggacgcaggagagcgccugcaacugcaucggcggggauugcuaccugaugaucaccgacggcagcgccuccggcaucucgaagugucgcuuccugaagauccgggaggggcgcaucaucaaggagaucuuccccaccggccgggucgagcacaccgaggagugcacgugcggguuugccuccaacaagaccaucgagugcgcgugccgcgacaacaguuacaccgccaagcggcccuucgugaagcucaacguggagaccgacacggccgagauccgccugauguguaccgagaccuaccuggacaccccgcggcccgacgacggcuccaucacggggcccugcgagaguaacggcgacaagggccgcgggggcaucaagggcggguucguccaccagcggauggccuccaagaucgggcgcugguacagucggaccauguccaagaccgagcgcaugggcauggagcucuacgugaaguacgacggcgaccccuggaccgauagcgaggcccuggcgccguccggggugauggucagcauggaggagcccggcugguacuccuucggguucgagaucaaggauaagaagugcgacgugcccugcaucggcaucgagauggugcacgacgggggcaagaagacguggcauagcgccgccaccgccaucuacugccugaugggcuccgggcagcuccugugggacaccgucaccggcguggacauggcccuguga

SEQ ID NO: 28787 - RNA, 1401 nt, Artificial Sequence
  derived and/or modified CDS sequence (AUadapt) from InfluenzaB__ABL77281__NA
augcugcccaguaccauccagacccucacgcuguuccugaccuccggcggggugcuccugagccuguacgucuccgugagccucuccuaucugcuguacagcgacauccuccugcgcuucuccccgaccgagaucaccgcccccacgaugccccuggauugcgccaacgcgagcaacgugcaggccgucaaccgguccgccaccaagggcaugacccuccgccugcccgagccggaguggaccuauccccggcugagcugccccggguccacguuccagaaggcccuccugaucagcccccaucgcuucggcgagacccgggggaacuccgccccgcugaucauccgcgagcccuucaucgcgugcggccccaaggagugcaagcauuucgcccucacccacuacgccgcccagcccggcggguacuauaacggcacccgggaggaccgcaacaagcugcggcaccugaucagcgugaagcucgggaagaucccgacgguggagaauuccaucuuccacauggcggccuggagcggcuccgccugccaugacgggcgcgaguggaccuacaucggcgucgacggccccgacucgaaugcccugaucaagaucaaguacggggaggccuacaccgacaccuaccauuccuacgcgaacaacauccugcggacgcaggagagcgccuguaacugcaucggcggggacugcuaccucaugaucaccgauggcagcgccuccgagaucagcaagugccgcuuccugaagauccgggagggccgcaucaucaaggagaucuuucccaccgggcggguggagcacaccgaggagugcacgugcggcuucgccuccaacaagaccaucgagugugccugccgcgacaacagcuauaccgcgaagcggcccuucgugaagcugaacgucgagaccgacacggccgagauccgccucaugugcaccgagaccuaccuggauaccccgcggcccgacgacggguccaucacgggccccugcgagagcaauggggacaagggccgcggcgggaucaagggcggguucgugcaccagcggauggccuccaagaucggccgcugguacagccgcaccauguccaagaccgagcggauggggauggagcuguaugugaaguacgacggcgaccccuggaccgacagugaggcccucgccccguccggcgucauggugagcauggaggagcccgggugguacuccuucggcuucgagaucaaggacaagaagugugacgugcccugcaucgggaucgagaugguccacgacggcgggaagaagacguggcauagcgcggccaccgccaucuacugccugaugggcuccggccagcugcucugggacaccgugaccgggguggacauggcccuguga

SEQ ID NO: 28788 - RNA, 1401 nt, Artificial Sequence
  derived and/or modified CDS sequence (AUadapt) from InfluenzaB__ABL77292__NA
augcugcccaguaccauccagacccucacgcuguuccugaccuccggcggggugcuccugagccuguacgucuccgccagccucuccuaucugcuguacagcggcgugcuccugaaguucuccccgaccgagaucaccgcccccacgaugccccuggacugcgcgaaugccagcaacgugcaggccgucaaccgcuccgccaccaagggggugacccuccugcugcccgagccggaguggaccuacccccggcucagcugucccggcuccacguuccagaaggcccugcugaucagcccccaccgcuucggggagacccggggcaauuccgcgccgcucaucauccgcgagcccuucaucgccugcggccccaaggagugcaagcacuucgcccugacccauuacgccgcgcagcccgggggcuacuacaacgggacccgggaggaccgcaauaagaugcggcaccugaucagcgugaagcucggcaagaucccgacggucgagaacuccaucuuccacauggccgccuggaguggguccgccugccacgacggccgcgaguggaccuacaucggcguggaugggcccgacagcaacgcccugaucaagaucaaguacggcgaggcguacaccgauaccuaccacuccuacgccaacaacauccugcggacgcaggagagugccugcaacugcaucgggggcgacuguuaccucaugaucaccgacggcagcgccuccgggaucagcaagugccgcuuucugaagauccgggagggccgcaucaucaaggagaucuuccccaccgggcggguggagcacaccgaggagugcacgugcggcuucgccuccaauaagaccaucgagugcgcgugccgcgacaacagcuauaccgccaagcggcccuucgucaagcugaacguggagaccgacacggccgagauccgccucaugugcaccgagaccuaucuggacaccccgcggcccgacgacggguccaucacgggccccugcgagagcaauggcgacaaggggcugggcgggaucaagggcggguucgugcaccagcgcauggccuccaagaucggccggugguacagccgcaccauguccaagaccgagcggaugggcauggagcucuaugucaaguacgacggggaccccuggaccgacagugacgcccuggcgcuguccggcgugauggugagcauggaggagccggggugguacuccuucggcuucgagaucaaggauaagaagugcgacguccccugcaucgggaucgagauggugcacgacggcggcaagaagacguggcauagcgccgccaccgccaucuacugccucaugggguccggccagcugcugugggacaccgugaccggggucgacauggcccucuga

SEQ ID NO: 28789 - RNA, 1398 nt, Artificial Sequence
  derived and/or modified CDS sequence (AUadapt) from InfluenzaB__ABL77303__NA
augcugcccaguaccauccagacccucacgcuguuccugaccuccggcggggugcuccugagccuguacgucuccgcccuccugagcuaccugcucuacuccgacauccugcugaaguuuucgccgaagaucaucgcccccaccaucucccucgacugcgcgaacgccagcaacgugcaggccgugaaccacuccgccaccaaggagaugacguuucugcugcccgagcccgaguggaccuacccgcgccucagcugccagggcuccaucuuccagaaggcccugcugaucucgccccaccgguucggggaggcgaagggcaacuccgcgccccucaucauccgcgagcccuuuaucgccugcgggccgaaggagugcaagcacuucgcccugacccacuacgccgcccagcccggcggcuacuacaaugggacccgggaggaccgcaacaagcugcggcaccucaucagcgucaaccugggcaagauccccacgguggagaacuccaucuuccacauggccgccuggaguggguccgccugccacgacggccgcgaguggaccuacaucgggguggacggccccgacucgaacgcgcugaucaagaucaaguauggcgaggccuacaccgacaccuaccacuccuacgccaacaacauccuccggacgcaggagagcgccuguaacugcaucgggggcgacugcuaccugaugaucaccgacgggagcgccuccggcaucaguaagugccgcuuccugaagauccgggagggccgcaucaucaaggagaucuucccgaccgggcgggucgagcacaccgaggagugcacgugcggcuucgcguccaacaagaccaucgagugugccugccgcgacaacagcuacaccgccaagcggcccuucgugaagcucaacguggagaccgacacggccgagauccgccugauguguaccgagaccuaccuggacacgccccggcccgacgacggguccaucaccggcccgugcgagagcaacggggacaagggccgcggcggggucaagggcggguuugugcaccagcggaucgccuccaagaucggccgcugguacucgcggaccauguccaagaccgagcgcauggggauggagcucuacgugaaguacgacggcgaccccuggaccgacagugacgcgcuggcccccuccggcgucauggugagcauggaggagcccgggugguacuccuucggcuucgagaucaaggacaagaagugcgacgugccguguaucgggaucgagaugguccacgacggcgggaagaagacguggcacagcgccgccaccgccaucuacugccugaugggcuccggccagcuccugugggacaccgugaccgggguggacauggcgcuguga

SEQ ID NO: 28790 - RNA, 1398 nt, Artificial Sequence
  derived and/or modified CDS sequence (AUadapt) from InfluenzaB__ABL77314__NA
augcugcccaguaccauccagacccucacgcuguuccugaccuccggcggggugcuccugagccuguacgucuccgcccuccugagcuaccugcucuacuccgaugugcugcugaaguucucgccgaagaucaucgcccccaccaugucccucgacugcgcgaacgccagcaacgugcaggccgucaaucacuccgccaccgaggagaugacguuccugcugcccgagcccgaguggaccuacccgcgccucagcugccagggcuccaccuuccagaaggcccugcugaucagcccccaucgguucggggaggcgaagggcaacuccgcgccccucaucauccgcgagcccuucaucgccugcgggccgaaggagugcaagcacuucgcccugacccauuacgccgcccagcccggcggcuacuacaacgggacgcgggaggaccgcaacaagcugcggcaccucaucagugugaaccugggcaagauccccaccguggagaacuccaucuuccacauggccgccuggagcggguccgccugccaugacggccgcgaguggaccuacaucggggucgacggccccgacagcaacgcgcugaucaagaucaaguacggcgaggccuauaccgacacguaccacuccuacgccaacaacauccuccggacccaggagagcgccuguaacugcaucgggggcgacugcuaccugaugaucaccgacgggucggccuccggcaucaguaagugccgcuuccugaagauccgggagggccgcaucaucaaggagaucuucccgaccgggcggguggagcacacggaggagugcacgugcggcuucgcguccaauaagaccaucgagugcgccugccgcgacaacagcuacaccgccaagcggcccuuugugaagcucaacgucgagaccgacaccgccgagauccgccugaugugcaccgagaccuaccuggacacgccccggcccgacgacggguccaucaccggcccgugugagagcaacggggacaagggccacggcgggaucaagggcggguucgugcaccagcgcauggccuccaagaucggccggugguacagucgcaccauguccaagaccaagcggauggggauggagcucuacgugaaguacgacggcgaccccuggacggacagcgacgcgcuggcccccuccggcgucauggugaguauggaggagcccgggugguacuccuucggcuucgagauccgcgacaagaagugcgacgugccgugcaucgggaucgagaugguccaugacggcgggaagaagaccuggcacagcgccgccaccgccaucuacugccugaugggcuccggccagcuccugugggacaccgugacggggguggacauggcgcuguga

SEQ ID NO: 28791 - RNA, 1401 nt, Artificial Sequence
  derived and/or modified CDS sequence (AUadapt) from InfluenzaB__ABL77325__NA
augcugcccaguaccauccagacccucacgcuguuccugaccuccggcggggugcuccugagccuguacgucuccgcccuccugagcuacucccuguauagcgacauccuccugaaguucuccccgaccaagaccaucgcccccacgaugucgcuggacugcgcgaaugccuccaacgugcaggccgugaaccacagcgccaccaagggcaugacccuccugcugcccgagcccgaguggaccuacccgcgccucuccugucaggggagcacguuccagaaggcccugcugaucagcccccaccgguucggcgagaccaaggggaacuccgcgccccucaucauccgcgagcccuuuaucgccugcggcccgaaggagugcaagcacuucgcccugacccacuaugccgcgcagcccggcggguacuacaacggcacccgggaggaccgcaacaagcugcggcaccucaucuccgucagucuggggaagauccccacgguggagaacuccaucuuccacauggccgccuggagcggcuccgccugccaugacgggcgcgaguggaccuacaucggcguggacggccccgacagcaacgcccugaucaagaucaaguauggggaggcguacaccgacaccuaccacagcuaugccaacaacauccuccggacgcaggaguccgccugcaacugcaucggcggggacuguuaccugaugaucaccgacggcucggccuccggcaucagcaagugccgcuuucugaagauccgggaggggcgcaucaucaaggagaucuucccgaccggccgggucgaccacaccgaggagugcacgugcggguucgccuccaauaagaccaucgagugcgcgugccgcgacaacagcuauaccgccaagcggcccuucgugaagcucaacguggagaccgacacggccgagauccgccugaugugcaccgagaccuaccuggacacgccccggcccgaugacggcuccaucaccgggccgugcgagagcaacggcgacaagggccgcgggggcaucaagggcggguuuguccaccagcggauggccuccaagaucgggcgcugguacucgcggaccauguccaagaccgagcgccucggcauggagcuguacgugaaguacgacggcgaucccuggaccgacagcgacgcccuggcgcccuccggggugauggucagcgccgaggagcccggcugguacuccuuuggguucgagaucaaggacaagaagugcgacgugccgugcaucggcaucgagauggugcacgaugggggcaagaagacguggcacagcgccgccaccgccaucuacugccucaugggcuccgggcagcugcugugggacaccgucaccggcguggacauggcgcucuga

SEQ ID NO: 28792 - RNA, 1401 nt, Artificial Sequence
  derived and/or modified CDS sequence (AUadapt) from InfluenzaB__ABL77336__NA
augcugcccaguaccauccagacccucacgcuguuccugaccuccggcggggugcuccugagccuguacgucuccgccagccucuccuaucugcuguacagcgacauccuccugaaguucuccccgaccgagaucaccgccccgcccaugccccuggacugugcgaacgccagcaacgugcaggccgugaaccgcuccgccacgaagggcgucacccuccugcugcccgagcccgaguggaccuacccccggcucaguugccccggguccaccuuccagaaggcccugcugaucagcccgcaccgcuucggcgagacgcgggggaauuccgcgccccucaucauccgcgagcccuucaucgccugcggccccaaggagugcaagcacuucgccaucacccauuacgccgcgcagccgggcggguacuacaacggcacccgggaggaucgcaacaagcugcggcaccugaucagcgugaagcucgggaagauccccaccguggagaacuccaucuuccauauggccgccuggagcggcuccgccugccacgacgggcgcgaguggacguacaucggcgucgauggccccgacucgaacgcccugcugaagaucaaguacggggaggcguacaccgauaccuaccacuccuacgccaacaacauccuccggacccaggagagugccugcaacugcaucggcggggacuguuaccugaugaucacggacggcagcgccuccggcaucagcaagugccgcuuucugaagauccgggaggggcgcaucaucaaggagaucuuccccaccggccggguggagcacaccgaggagugcacgugcggguucgccuccaauaagaccaucgagugcgcgugccgcgacaacagcuauaccgccaagcggccguucgugaagcucaacgucgagaccgacaccgccgagauccgccugaugugcacggagaccuaccuggauacgccccggcccgacgacggcuccaucaccgggcccugcgagagcaauggcgacaagggccgcgggggcaucaagggcggguucgugcaccagcggauggccuccaagaucgggcgcugguacagccggaccauguccaagaccgaucgcaugggcauggagcucuacgugaaguacgacggcgacccguggaccgacagugacgcccuggcgcuguccggggucauggugagcauggaggagcccggcugguacuccuucggguucgagaucaaggauaagaagugcgacgugcccugcaucggcaucgagaugguccacgacgggggcaagaagaccuggcauagcgccgccacgaccaucuacugccucaugggcuccgggcagcugcugugggacaccgugaccggcguggacauggcccucuga

SEQ ID NO: 28793 - RNA, 1401 nt, Artificial Sequence
  derived and/or modified CDS sequence (AUadapt) from InfluenzaB__ABL77347__NA
augcugcccaguaccauccagacccucacgcuguuccugaccuccggcggggugcuccugagccuguacgucuccgccagccucuccuaccugcuguauagcgacauccuccugaaguucuccccgaccaagaucaccgcccccacgaugccccuggacugcgcgaaugccagcaacgugcaggccgugaaccacuccgccaccaagggcgucacccuccugcugcccgagccggaguggaccuacccccgccucaguugccccggguccacguuccagaaggcccugcugaucucgccccaccgguucggcgagacccgcgggaauuccgcgccgcucaucauccgggagcccuucaucgccugcggccccaaggagugcaagcacuucgcccugacccauuacgccgcgcagcccggcggguacuacaacggcacccgcgaggaccggaauaagcugcgccaccucaucagcgugaagcuggggaagaucccgacgguggagaacuccaucuuccacauggccgccuggagcggcuccgccugucacgacgggcgggaguggaccuacaucggcgucgacggccccgacaguaacgcccugcucaagaucaaguacggggaggcguacaccgacaccuaccauuccuacgccaacaacauccugcgcacgcaggagagcgccugcaauugcaucggcggggacugcuaccugaugaucaccgacggcagugccuccggcaucagcgagugccgguuccucaagauccgcgaggggcggaucaucaaggagaucuuccccaccggccgcguggagcacaccgaggaguguacgugcggguucgccuccaacaagaccaucgagugcgcgugccgggauaacucguacaccgccaagcgccccuucgugaagcugaacgucgagaccgacacggccgagauccggcugauguguaccgagaccuaccucgacaccccgcgccccgacgacggcuccaucacggggcccugcgagaguaacggcgacaagggcuccgggggcaucaagggcggguucgugcaccagcggauggccagcaagaucgggcgcugguauucccggaccaugagcaagaccaagcgcaugggcaugggccuguacgugaaguacgacggggaccccuggaccgauuccgacgcccuggcgcucagcggcgucaugguguccauggaggagccggggugguacagcuucggcuuugagaucaaggacaagaagugcgacgugcccugcaucgggaucgagaugguccacgauggcggcaagaagacguggcacuccgccgccaccgccaucuacugccugauggggagcggccagcugcucugggacaccgugaccgggguggacauggcccuguga

SEQ ID NO: 28794 - RNA, 1398 nt, Artificial Sequence
  derived and/or modified CDS sequence (AUadapt) from InfluenzaB__ABL77380__NA
augcugcccaguaccauccagacccucacgcuguuccugaccuccggcggggugcuccugagccuguacgucuccgcccuccugucguaccugcucuacuccgacauccugcugaaguuuagcccgaagaucaucgcccccaccaccucccucgacugcgcgaacgccagcaacgugcaggccgugaaccauuccgccacgaaggagaugaaguuccugccgcccgagcccgaguggaccuacccccgccugucgugccagggcuccaccuuccagaaggcccuccugaucagcccccaccgguucggggaggcgaagggcaauuccgcgccccugaucauccgcgagccguucaucgccugcgggcccaaggagugcaagcacuucgcccucacccacuacgccgcccagcccggcggcuauuacaacgggacgcgggaggaccgcaacaagcugcggcaccugaucucggucaaccucggcaagauccccaccguggagaauuccaucuuccacauggccgccuggagcggguccgccugccacgacggccgcgaguggaccuacaucgggguggacggcccggauagcaacgcgcugaucaagaucaaguacggcgaggccuacaccgacacguaccacuccuaugccaacaacauccugcggacccaggagucggccugcaacugcaucgggggcgacuguuaccucaugaucaccgacgggagcgccuccggcaucucgaagugccgcuuccugaagauccgggagggccgcaucaucaaggagaucuuccccaccgggcgggucgagcacacggaggaguguacgugcggcuucgcguccaacaagaccaucgagugcgccugccgcgacaacaguuacaccgccaagcggcccuucgugaagcugaacguggagaccgacaccgccgagauccgccucaugugcaccgagaccuaccuggacacgccccggccggaugacggguccaucaccggccccugcgagagcaacggggacaagggcuccggcggggucaagggcggguucgugcaccagcgcauggccucgaagaucggccggugguauucccgcaccaugagcaagaccaagcggauggggauggagcuguacgugaaguacgacggcgaccccuggacggacuccgacgcgcucgcccccaguggcgucaugguguccauggaggagccggggugguacagcuucggcuucgagaucaaggacaagaagugcgacgugcccuguaucgggaucgagaugguccacgacggcgggaagcgcaccuggcacuccgccgccaccgccaucuacugccugaugggcagcggccagcugcucugggacaccgugacgggggugaacauggcgcuguga

SEQ ID NO: 28795 - RNA, 1401 nt, Artificial Sequence
  derived and/or modified CDS sequence (AUadapt) from InfluenzaB__ABL77391__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccucgaacgugcaggccgugaaccgcuccgccaccaagggcgucacccuccugcugcccgagccggaguggaccuacccccggcucagcugccccggguccacguuucagaaggcccugcugaucagcccccaccgcuucggcgagaccaaggggaacuccgcgccgcucaucauccgggagcccuucaucgccuguggccccaaggagugcaagcacuucgcccugacccacuacgccgcgcagcccggcggguacuauaacggcacccgcggggaccggaacaagcugcgccaccucaucagcgugaagcugggcaagaucccgacgguggagaauuccaucuuccacauggccgccuggagcggguccgccugccacgauggcaaggaguggaccuacaucggcgucgacgggcccgacaacaacgcccugcucaagaucaaguacggcgaggcguauaccgacaccuaccacucguacgccaauaacauccugcggacgcaggaguccgccugcaacugcaucgggggcaacugcuaucugaugaucaccgacggcagcgccagcgggguguccgagugccgcuuccucaagauccgggagggccgcaucaucaaggagaucuuucccaccgggcgggugaagcacaccgaggagugcacgugcggcuucgccagcaacaagaccaucgagugugcgugccgcgacaacuccuacaccgccaagcggcccuucgucaagcugaauguggagaccgacacggccgagauccgccugaugugcaccgagaccuaccucgacaccccgcggcccgacgaugggagcaucacgggccccugcgaguccaacggcgacaaggggucgggcgggaucaagggcggguucgugcaucagcgcauggccuccaagaucggccggugguacagccgcaccauguccaagaccaagcggaugggcauggggcuguacgucaaguacgacggcgaucccugggccgacagcgacgcgcuggcccucuccggggugauggugagcauggaggagccgggcugguacuccuucggguuugagaucaaggacaagaagugcgacguccccugcaucggcaucgagauggugcacgauggcgggaaggagaccuggcacagcgccgccacggccaucuacugccugaugggcuccgggcagcugcucugggacaccgugaccggcgucgacauggcgcuguga

SEQ ID NO: 28796 - RNA, 1401 nt, Artificial Sequence
  derived and/or modified CDS sequence (AUadapt) from InfluenzaB__ABL84344__NA
augcugcccaguaccauccagacccucacgcuguuccugaccuccggcggggugcuccugagccuguacgucuccgccagccucuccuaccugcuguauagcgacauccuccugaaguucuccagcaccgagaucaccgccccgacgaugccccugaacugcgcgaaugccuccaacgugcaggccgugaaccacucggccaccaagggcgucacccucccccugcccgagccggaguggaccuacccccgccuguccugccccgggaguacguuccagaaggcccuccugaucagcccccaccgguucggcgagaccaaggggaacuccgcgccgcugaucauccgcgagcccuucaucgccuguggccccaaggagugcaagcacuucgcccucacccacuacgccgcgcagcccggcggguacuauaacggcacccgggaggaccgcaacaagcugcggcaccugaucuccgugaagcucgggaagaucccgacgguggagaacagcaucuuucacauggccgccugguccggcagcgccugccacgacgggcgcgaguggaccuauaucggcgucgacggccccgacuccaacgcccugcugaagaucaaguacggggaggcguacaccgacaccuaucacucguacgccaacaacauccuccggacgcaggagagcgccuguaacugcaucggcggggacugcuaccugaugaucaccgacggcuccgccaguggcguguccgagugccgcuuccugaagauccgggaggggcgcaucaucaaggagaucuuccccaccggccggguggagcacaccgaggagugcacgugcggguuugccagcaacaagaccaucgagugcgcgugccgcgacaacuccuauaccgccaagcggcccuucgucaagcucaacguggagaccgacacggccgagauccgccugaugugcaccgagaccuaccuggauaccccgcggcccgacgacggcagcaucacggggcccugcgaguccaacggcgacaagggcagugggggcaucaagggcggguucgugcaccagcgcauggccuccaagaucgggcggugguacagccgcaccauguccaagaccaagcggaugggcaugggccucuacgucaaguacgauggggaccccuggaucgacagcgacgcccugacccuguccggcgugauggugagcauggaggagccggggugguacuccuuuggcuucgagaucaaggacaagaagugcgacguccccugcaucgggaucgagauggugcacgauggcggcaaggagacguggcacagcgcggccaccgccaucuacugccucaugggguccggccagcugcugugggacaccgugaccggggucgacauggcccucuga

SEQ ID NO: 28797 - RNA, 1401 nt, Artificial Sequence
  derived and/or modified CDS sequence (AUadapt) from InfluenzaB__ABN50397__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccugaacugcgcgaacgccagcaacgugcaggccgugaaucgcuccgccaccaagggcgucacccuccugcugcccgagccggaguggaccuacccccggcucagcugccccggguccacguuccagaaggcccugcugaucucgccccaccgcuucggcgagaccaaggggaauuccgcgccgcucaucauccgggagcccuucaucgccugcggccccaaggagugcaagcacuucgcccugacccacuaugccgcgcagcccggcggguacuacaacggcacccgcgaggaccggaacaagcugcgccaccucaucagcgugaagcuggggaagaucccgacgguggagaauuccaucuuccacauggccgccuggagcggcuccgccugccacgacgggcgggaguggaccuacaucggcgucgauggccccgacagcaacgcccugcucaagaucaaguacggggaggcguacaccgacaccuaucacuccuacgccaacaacauccugcgcacgcaggagucggccugcaacuguaucggcggggacugcuaccugaugaucaccgacggcagcgccuccggcaucagcgagugccgguuucucaagauccgcgaggggcggaucaucaaggagaucuuccccaccggccgcguggagcacaccgaggagugcacgugcggguucgccuccaacaagaccaucgagugugcgugccgggacaacucguacaccgccaagcgccccuucgugaagcugaacgucgagaccgauacggccgagauccggcugaugugcaccgagaccuaccucgacaccccgcgccccgacgacggcuccaucacggggcccugcgagagcaauggcgacaagggcuccgggggcaucaagggcggguucgugcaccagcggauggccagcaagaucgggcgcugguacucccggaccaugucgaagaccaagcgcaugggcaugggccuguaugugaaguacgacggggaccccuggaucgacuccgacgcccugacccucagcggcgucaugguguccauggaggagccggggugguacaguuucggcuucgagaucaaggacaagaagugcgacgugcccugcaucgggaucgagaugguccacgauggcggcaagaagacguggcacuccgcggccaccgccaucuacugccugauggggagcggccagcugcucugggacaccgugaccgggguggacauggaccuguga

SEQ ID NO: 28798 - RNA, 1401 nt, Artificial Sequence
  derived and/or modified CDS sequence (AUadapt) from InfluenzaB__ABN50408__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccugaacugcgcgaacgccaguaacgugcaggccgugaaccgcuccgccaccaagggcgucacccucccccugccggagcccgaguggaccuacccccggcugagcugccccggguccacguuccagaaggcccuccugaucaguccgcaccgcuucggcgagaccaaggggaacuccgcgccccugaucauccgggagcccuucaucgccugcggccccaaggagugcaagcauuucgcccucacccacuacgccgcgcagccgggcggguacuacaauggcacccgcgaggaccggaacaagcugcgccaccugaucagcgugaagcucgggaagauccccacgguggagaacuccaucuuccauauggccgccuggucgggcuccgccugccacgacgggcgggaguggaccuacaucggcgucgacggccccgauagcaacgcccugcugaagaucaaguacggggaggcguacaccgacaccuaccauuccuacgccaacaacauccuccgcacgcaggagagcgccugcaacuguaucggcggggacugcuaccugaugaucaccgacggcagcgccuccggcaucagugagugccgguuccugaagauccgcgaggggcggaucaucaaggagaucuuccccaccggccgcguggagcacaccgaggagugcacgugcggguuugccuccaacaagaccaucgagugcgcgugccgggacaacagcuauaccgccaagcgcccguucgugaagcucaacgucgagaccgacacggccgagauccggcugaugugcaccgagaccuaccuggacacgccccgccccgaugacggcuccaucaccgggcccugcgagagcaacggcgacaagggcuccgggggcaucaagggcggguuugugcaccagcggauggccagcaagaucgggcgcugguacucccggaccaugucgaagaccaagcgcaugggcaugggccucuacgugaaguacgauggggacccguggaucgacuccgacgcccugacccugagcggcgucaugguguccauggaggagcccgggugguacagcuuuggcuucgagaucaaggacaagaagugcgacgugcccugcaucgggaucgagaugguccacgauggcggcaagaagacguggcacuccgcggccaccgccaucuacugccucauggggagcggccagcugcugugggacaccgugaccgggguggacauggcccucuga

SEQ ID NO: 28799 - RNA, 1401 nt, Artificial Sequence
  derived and/or modified CDS sequence (AUadapt) from InfluenzaB__ABN50419__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccucgaaugugcaggccgugaaccgcuccgccaccaagggcgucacccuccugcugcccgagccggaguggaccuacccccggcucagcugccccggguccacguuccagaaggcccugcugaucagcccccaucgcuucggcgagaccaaggggaacuccgcgccgcucaucauccgggagcccuucaucgccugcggccccaaggagugcaagcacuuugcccugacccacuacgccgcgcagcccggcggguacuacaacggcacccgcggggaccggaauaagcugcgccaccucaucagcgugaagcugggcaagaucccgacgguggagaacuccaucuuccacauggccgccuggucgggguccgccugccaugacggcaaggaguggaccuacaucggcgucgacgggcccgacagcaacgcccugcucaagaucaaguauggcgaggcguacaccgacaccuaccacuccuacgccaacaauauccugcggacgcaggagagcgccugcaacugcaucgggggcaacugcuaucugaugaucaccgacggcagcgccuccgggaucucggagugccgcuuccucaagauccgggagggccgcaucaucaaggagaucuuccccaccgggcgggugaagcauaccgaggagugcacgugcggcuucgccuccaacaagaccaucgagugcgcgugccgcgauaacagcuacaccgccaagcggcccuucgugaagcugaacgucgagaccgacacggccgagauccgccugaugugcaccgagaccuaucucgacaccccgcggcccgacgacggguccaucacgggccugugcgagagcaacggcgauaagggguccggcgggaucaagggcggguucgugcaccagcgcauggccagcaagaucggccggugguacucccgcaccaugucgaagaccaagcggaugggcauggggcuguacgugaaguaugacggcgaccccuggaccgacuccgacgcccucgcgcugagcggggucaugguguccauggaggagcccggcugguacaguuucggguucgagaucaaggacaagaagugcgacgugccgugcaucggcaucgagaugguccaugacggcgggaaggagacguggcacuccgccgccaccgccaucuacugccugaugggcagcgggcagcuccugugggacaccgugaccggcguggacauggcccuguga

SEQ ID NO: 28800 - RNA, 1401 nt, Artificial Sequence
  derived and/or modified CDS sequence (AUadapt) from InfluenzaB__ABN50430__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaaggagugcaagcauuucgcccugacccacuacgccgcgcagcccggcggguacuacaauggcacccgcggggaccggaacaagcugcgccaccucaucagcgugaagcugggcaagaucccgacgguggagaacuccaucuuccauauggccgccuggucgggguccgccugccacgacggcaaggaguggaccuacaucggcgucgacgggcccgauagcaacgcccugcucaagaucaaguacggcgaggcguacaccgacaccuaccauuccuacgccaacaacauccugcggacgcaggagagcgccugcaacuguaucgggggcaacugcuaccugaugaucaccgacggcagcgccuccgggaucagugagugccgcuuccucaagauccgggagggccgcaucaucaaggagaucuuccccaccgggcgggugaagcacaccgaggagugcacgugcggcuuugccuccaacaagaccaucgagugcgcgugccgcgacaacagcuauaccgccaagcggcccuucgugaagcugaacgucgagaccgacacggccgagauccgccugaugugcaccgagaccuaccucgacaccccgcggcccgaugacggguccaucacgggccccugcgagagcaacggcgacaagggguccggcgggaucaagggcggguuugugcaccagcgcauggccagcaagaucggccggugguacucccgcaccaugucgaagaccaagcggaugggcauggggcuguacgugaaguacgauggcgaccccuggaccgacuccgacgcccuggcgcucagcggggucaugguguccauggaggagccgggcugguacagcuuuggguucgagaucaaggacaagaagugcgacgugcccugcaucggcaucgagaugguccacgauggcgggaaggagacguggcacuccgccgccaccgccaucuacugccugaugggcagcgggcagcugcucugggacaccgugaccggcguggacauggcccuguga

SEQ ID NO: 28801 - RNA, 1401 nt, Artificial Sequence; identical to SEQ ID NO: 28783
  derived and/or modified CDS sequence (AUadapt) from InfluenzaB__ABN50463__NA

SEQ ID NO: 28802 - RNA, 1401 nt, Artificial Sequence; identical to SEQ ID NO: 28697
  derived and/or modified CDS sequence (AUadapt) from InfluenzaB__ABN50474__NA

SEQ ID NO: 28803 - RNA, 1401 nt, Artificial Sequence
  derived and/or modified CDS sequence (AUadapt) from InfluenzaB__ABN50485__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccucgaaugugcaggccgugaaccgcuccgccaccaagggcgucacccuccugcugcccgagccggaguggaccuacccccggcucagcugccccggguccacguuccagaaggcccugcugaucagcccccaucgcuucggcgagaccaaggggaacuccgcgccgcucaucauccgggagcccuucaucgccugcggccccaaggagugcaagcacuuugcccugacccacuacgccgcgcagcccggcggguacuacaacggcacccgcggggaccggaauaagcugcgccaccucaucagcgugaagcugggcaagaucccgacgguggagaacuccaucuuccacauggccgccuggagcggguccgccugccaugacggcaaggaguggaccuacaucggcgucgacgggcccgacucgaacgcccugcucaagaucaaguauggcgaggcguacaccgacaccuaccacuccuacgccaacaauauccugcggacgcaggagagcgccugcaacugcaucgggggcaacugcuaucugaugaucaccgacggcagcgccuccgggaucagcgagugccgcuuccucaagauccgggagggccgcaucaucaaggagaucuuccccaccgggcgggugaagcauaccgaggagugcacgugcggcuucgccuccaacaagaccaucgagugcgcgugccgcgauaacagcuacaccgccaagcggcccuucgugaagcugaacgucgagaccgacacggccgagauccgccugaugugcaccgagaccuaucucgacaccccgcggcccgacgacggguccaucacgggccccugcgaguucaacggcgauaaggggucgggcgggaucaagggcggguucgugcaccagcgcauggccuccaagaucggccggugguacagccgcaccauguccaagaccaagcggaugggcauggggcuguacgugaaguaugacggcgaccccuggaccgacagcgacgcccuggcgcucuccggggucauggugagcauggaggagccgggcugguauuccuucggguucgagaucaaggacaagaagugcgacgugcccugcaucggcaucgagaugguccaugacggcgggaaggagacguggcacagcgccgccaccgccaucuacugccugaugggcuccgggcagcugcucugggacaccgugaccggcguggacauggcccuguga

SEQ ID NO: 28804 - RNA, 1401 nt, Artificial Sequence
  derived and/or modified CDS sequence (AUadapt) from InfluenzaB__ABN50496__NA
augcugcccaguaccauccagacccucacgcuguuccugaccuccggcggggugcuccugagccuguacgucuccgccagccucuccuaccugcuguacagugacauccuccugaaguucccguccaccgagaucaccgcccccacgaugccccuggacugcgcgaacgccagcaacgugcaggccgugaaucgcuccgccaccaagcgggucacccuccugcugcccgagccggaguggaccuacccccgccucagcugccccggcuccacguuccagaaggcccugcugaucucgccccaccgguucggggagaccaagggcaauuccgcgccgcucaucauccgcgagcccuucaucgccugcgggcccaaggagugcaagcacuucgcccugacccacuaugccgcgcagcccggcggcuacuacaacgggacccggggcgaccgcaacaagcugcggcaccucaucagcgugaagcuggggaagaucccgacgguggagaauuccaucuuccacauggccgccuggagcggcuccgccugccacgacgggaaggaguggaccuacaucggcgucgauggccccgacaacaacgcccugcucaagaucaaguacggggaggcguacaccgacaccuaucacucguacgccaacaacauccugcgcacgcaggaguccgccugcaacuguaucggcgggaacugcuaccugaugaucaccgacggcagcgccagcggcguguccgagugccgguuucucaagauccgcgaggggcggaucaucaaggagaucuuccccaccggccgcaucaagcacaccgaggagugcacgugcggguucgccucgaauaagaccaucgagugcgcgugccgggacaacuccuacaccgccaagcgccccuucgugaagcugaacgucgagaccgauacggccgagauccggcugaugugcaccgagaccuaccucgacaccccgcgccccgacgacggcagcaucacggggcccugcgaguccaauggcgacaagggcagcgggggcaucaagggcggguucgugcaccagcggauggccuccaagaucgggcgcugguacucgcggaccauguccaagaccaagcgcaugggcaugggccuguaugugaaguacgacggggaccccugggccgacagcgacgcgcuggccuucuccggcgucauggugaguauggaggagccggggugguacuccuucggcuucgagaucaaggacaagaagugcgacgugcccugcaucgggaucgagaugguccaugacggcggcaaggagaccuggcacagcgccgccacggccaucuacugccucaugggguccggccagcugcugugggacaccgugaccggggugaacauggcgcucuga

SEQ ID NO: 28805 - RNA, 1401 nt, Artificial Sequence
  derived and/or modified CDS sequence (AUadapt) from InfluenzaB__ABN50507__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccugaacugcgcgaaugccagcaacgugcaggccgugaaccgcuccgccaccaagggcgucacccucccccugccggagcccgaguggaccuacccccggcugagcugucccggguccacguuccagaaggcccuccugaucucgccgcaccgcuucggcgagaccaaggggaacuccgcgccccugaucauccgggagcccuuuaucgccugcggccccaaggagugccgccacuucgcccucacccacuaugccgcgcagccgggcggguacuacaacggcacccgggaggaccgcaacaagcugcggcaucugaucagcgugaagcucgggaagauccccacgguggagaacuccaucuuccacauggccgccuggagcggcuccgccugucacgacgggcgcgaguggaccuacaucggcgucgacggccccgacaguaacgcccugcugaagaucaaguacggggaggcguacaccgacaccuaccauuccuacgccaacaacauccuccggacgcaggagagcgccugcaacuguaucggcggggacugcuaccugaugaucaccgacggcagcgccuccggcaucagugagugccgcuuccugaagauccgggaggggcgcaucaucaaggagaucuuccccaccggccggguggagcacaccgaggagugcacguguggguucgccuccaacaagaccaucgagugcgcgugccgcgacaauucguacaccgccaagcggccguucgugaagcucaacgucgagaccgacacggccgagauccgccugauguguaccgagaccuaccuggacacgccccggcccgacgacggcuccaucaccgggcccugcgagaguaacggcgacaagggcuccgggggcaucaagggcggguucgugcaccagcgcauggccagcaagaucgggcggugguauucccgcaccaugagcaagaccaagcggaugggcaugggccucuacgugaaguacgacggggacccguggaucgauuccgacgcccugacccugagcggcgucaugguguccauggaggagcccgggugguacagcuucggcuuugagaucaaggacaagaagugcgacgugcccugcaucgggaucgagaugguccacgauggcggcaagaagacguggcacuccgcggccaccgccaucuacugccucauggggagcggccagcugcugugggacaccgugaccgggguggacauggcccucuga

SEQ ID NO: 28806 - RNA, 1401 nt, Artificial Sequence; identical to SEQ ID NO: 28704
  derived and/or modified CDS sequence (AUadapt) from InfluenzaB__ABN50518__NA

SEQ ID NO: 28807 - RNA, 1401 nt, Artificial Sequence; identical to SEQ ID NO: 28704
  derived and/or modified CDS sequence (AUadapt) from InfluenzaB__ABN50529__NA

SEQ ID NO: 28808 - RNA, 1401 nt, Artificial Sequence; identical to SEQ ID NO: 28697
  derived and/or modified CDS sequence (AUadapt) from InfluenzaB__ABN50540__NA

SEQ ID NO: 28809 - RNA, 1401 nt, Artificial Sequence; identical to SEQ ID NO: 28729
  derived and/or modified CDS sequence (AUadapt) from InfluenzaB__ABN50551__NA

SEQ ID NO: 28810 - RNA, 1401 nt, Artificial Sequence
  derived and/or modified CDS sequence (AUadapt) from InfluenzaB__ABN50562__NA
augcugcccaguaccauccagacccucacgcuguuccugaccuccggcggggcccuccugagccuguacguguccgcccuccugucguaccugcucuacuccgacauccugcugaaguuuagcccgaccaaggucaucgcgcccaccaugucccucgacuacacgaacgccagcaacgugcaggccgugaaccauuccgccaccgaggagaugaccuuccugcugcccgagcccgaguggaccuacccgcgccucucgugccagggcuccacguuccagaaggcccugcugaucagcccccaccgguucggggaggcgaagggcaauuccgcgccccucaucauccgcgagcccuucaucgccugcgggccgaaggagugcaagcacuucgcccugacccacuacgccgcccagcccggcggcuauuacaacgggacccgggaggaccgcaacaagcugcggcaccucaucagcgucaaccugggcaagauccccaccguggagaauuccaucuuccacauggccgccuggucgggguccgccugccacgacggccgcgaguggacguacaucgggguggacggccccgauagcaacgcgcugaucaagaucaaguacggcgaggccuacaccgacaccuaccacuccuaugccaacaacauccuccggacccaggagucggccugcaacugcaucgggggcgacuguuaccugaugaucacggacgggagcgccuccggcaucagccgcugccgguuccugaagauccgcgagggccggaucaucaaggagaucuucccgaccgggcgcgucgagcacaccgaggaguguacgugcggcuucgcguccaacaagaccaucgagugcgccugccgggacaacaguuacaccgccaagcgccccuucgugaagcucaacguggagaccgacaccgccgagauccggcugaugugcacggagaccuaccuggacacgccccgccccgaugacggguccaucaccggcccgugcgagagcaacggggacaagggcaacggcgggaucaagggcggguucguccaccagcggauggccucccgcaucggccggugguauagccgcaccauguccaagaccaagcggauggggauggagcucuacgugaaguacgacggcgaccccuggaccgacucggaugcgcuggcccccuccggcgugauggucagcauggaggagcccgggugguacuccuucggcuucgagaucaaggacaagaagugcgacgugccguguaucgggaucgagauggugcacgacggcgggaagaagaccuggcacagcgccgccacggccaucuacugccugaugggcuccggccagcuccugugggacaccgucaccgggguggacauggcgcuguga

SEQ ID NO: 28811 - RNA, 1401 nt, Artificial Sequence; identical to SEQ ID NO: 28800
  derived and/or modified CDS sequence (AUadapt) from InfluenzaB__ABN50573__NA

SEQ ID NO: 28812 - RNA, 1401 nt, Artificial Sequence
  derived and/or modified CDS sequence (AUadapt) from InfluenzaB__ABN50584__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgccagcacgaugccccuggacugcgcgaaugccuccaacgugcaggccgugaaccgcagcgccaccaagggcgucacccuccugcugcccgagcccgaguggaccuacccgcggcucuccugccccgggaguacguuccagaaggcccugcugaucagcccccaccgcuucggcgagaccaaggggaacuccgcgccccucaucauccgggagccguucaucgccuguggccccaacgagugcaagcacuucgcccugacccacuaugccgcgcagcccggcggguacuacaacggcacccgcggggaccggaacaagcugcgccaccucaucuccgugaagcugggcaagauccccacgguggagaauagcaucuuccacauggccgccugguccgggagcgccugccaugacggcaaggaguggaccuacaucggcgucgacgggccggacaacaacgcccugcucaagaucaaguauggcgaggcguacaccgacaccuaccacuccuacgccaauaacauccugcggacgcaggagagcgccugcaacugcaucgggggcaacuguuaccugaugaucaccgacggcagcgccuccggggugagcgagugccgcuuucucaagauccgggagggccgcaucaucaaggagaucuuccccaccgggcgggugaagcacaccgaggagugcacgugcggcuucgccuccaacaagaccaucgagugugcgugccgcgacaacucguacaccgccaagcggcccuuugucaagcugaacguggaguccgacaccgccgagauccgccugaugugcacggagaccuaccucgacacgccccggccggacgaugggagcaucaccggccccugcgaguccaacggcgacaaggggagcggcgggaucaagggcggguuugugcaccagcgcauggccuccaagaucggccggugguacagccgcaccauguccaagaccgagcggaugggcauggggcuguacgucaaguacgacggcgaucccugggccgacagcgacgcgcuggcccucuccggggugauggugagcauggaggagcccggcugguacuccuuuggguucgagaucaaggacaagaagugcgacgucccgugcaucggcaucgagauggugcacgauggcgggaaggagaccuggcacagcgccgccaccgccaucuacugccugaugggcuccgggcagcugcucugggacacggugaccggcgucgacauggcgcuguga

SEQ ID NO: 28813 - RNA, 1401 nt, Artificial Sequence; identical to SEQ ID NO: 28697
  derived and/or modified CDS sequence (AUadapt) from InfluenzaB__ABN50595__NA

SEQ ID NO: 28814 - RNA, 1398 nt, Artificial Sequence
  derived and/or modified CDS sequence (AUadapt) from InfluenzaB__ABN50606__NA
augcugcccaguaccauccagacccucacgcuguuccugaccuccggcggggugcuccugagccuguacgucuccgccagccucuccuaccugcuguauagcgacauccuccugcgcuucuccagcaagaucaccgccccgaccaugacgcuggacugugcgaacgccuccaacgugcaggccgugaaccggagcgccaccaaggagaugaccuuccuccugcccgagcccgaguggaccuauccccgccuguccugccagggcucgacguuccagaaggcccuccugaucuccccgcaccgguucggggaggcgcgcggcaauagcgcgccccugaucauccgggagcccuucaucgccugcgggcccaaggagugcaagcacuuugcccucacccacuacgccgcccagccgggcggcuacuacaacgggacccgcgaggaucggaacaagcugcgccaccugaucuccgucaagcucggcaagauccccaccguggagaacagcaucuuccacauggccgccugguccgggagugccugccacgacggccgggaguggacguacaucgggguggacggccccgauuccaacgcgcugaucaagaucaaguacggcgaggccuacaccgacaccuaccauagcuacgccaacaacauccugcgcacccaggagagcgccuguaacugcaucgggggcgacugcuaccucaugaucacggauggguccgccagcggcaucuccgagugccgguuccugaagauccgcgagggccggaucaucaaggagaucuuccccaccgggcgcgucgagcacaccgaggaguguacgugcggcuucgcgucgaacaagaccaucgagugcgccugucgggacaacuccuacaccgccaagcgcccguucgugaagcugaacguggagaccgacaccgccgagauccggcucauguguacggagaccuaccuggacacgccccgccccgacgacgggagcaucaccggccccugugaguccgacggggacaagggccggggcgggaucaagggcggguucguccaccagcgcauggccagcaagaucggccggugguauucccgcaccaugagcaagaccgagcgcauggggauggagcuguacgugaaguacgacggcgacccguggaccgauuccgacgcgcucgcccccagcggcgugauggucuccaugaaggagcccgggugguacagcuucggcuuugagaucaaggacaagaagugcgacgugcccugcaucgggaucgagauggugcacgauggcgggaagaagaccuggcacuccgccgccacggccaucuacugccugaugggcagcggccagcugcucugggacaccgucaccgggguggacauggcgcuguga

SEQ ID NO: 28815 - RNA, 1398 nt, Artificial Sequence
  derived and/or modified CDS sequence (AUadapt) from InfluenzaB__ABN50628__NA
augcugcccaguaccauccagacccucacgcuguuccugaccuccggcggggugcuccugagccuguacgucuccgcccuccugagcuaccugcucuacuccgacauccugcugaaguuuucgccgaagaucaucgcccccaccaugucccucgacugcgcgaacgccagcaacgugcaggccgugaaccauuccgccaccaaggagaugacguuccugcugcccgagcccgaguggaccuacccgcgccucagcugccagggcuccaccuuccagaaggcccugcugaucucgccccaccgguuuggggaggcgaagggcaacuccgcgccccucaucauccgcgagcccuucaucgccugcgggccgaaggagugcaagcacuucgcccugacccacuacgccgcccagcccggcggcuauuacaacgggacgcgggaggaccgcaacaagcugcggcaccucaucagcgucaaccugggcaagauccccaccguggagaauuccaucuuccacauggccgccuggagcggguccgccugccacgacggccgcgaguggaccuacaucgggguggauggccccgacucgaacgcgcugaucaagaucaaguacggcgaggccuacaccgacacguaccauuccuacgccaacaacauccuccggacccaggagagcgccugcaacugcaucgggggcgacuguuaccugaugaucaccgacgggagcgccuccggcaucucgaagugccgcuuccugaagauccgggagggccgcaucaucaaggagaucuucccgaccgggcgggucgagcauacggaggagugcacgugcggcuucgcguccaacaagaccaucgagugcgccugccgcgacaauagcuacaccgccaagcggcccuucgugaagcucaacguggagaccgacaccgccgagauccgccugaugugcaccgagaccuaccuggauacgccccggcccgacgacggguccaucaccggcccgugcgagagcaacggggacaagggccgcggcggggucaagggcggguucgugcaccagcggauggccuccaagaucggccgcugguauucgcggaccauguccaagaccgagcgcauggggauggagcucuacgugaaguacgacggcgaccccuggacggacagcgaugcgcuggcccccuccggcgucauggugagcauggaggagcccgggugguacuccuucggcuucgagaucaaggacaagaagugcgacgugccguguaucgggaucgagaugguccacgacggcgggaagaagaccuggcacagcgccgccaccgccaucuacugccugaugggcuccggccagcuccugugggacaccgugacggggguggacauggcgcuguga

SEQ ID NO: 28816 - RNA, 1398 nt, Artificial Sequence
  derived and/or modified CDS sequence (AUadapt) from InfluenzaB__ABN50639__NA
augcugcccaguaccauccagacccucacgcuguuccugaccuccggcggggugcuccugagccuguacgucuccgcccuccugagcuaccugcucuacuccgauauccugcugaaguucucgccgaagaucaucgcccccaccaugucccucgacugcgcgaacgccagcaacgugcaggccgugaaucacuccgccaccaaggagaugacguuccugcugcccgagcccgaguggaccuacccgcgccucagcugccagggcuccaccuuccagaaggcccugcugaucagcccccaucgguucggggaggcgaagggcaacuccgcgccccucaucauccgcgagcccuucaucgccugcgggccgaaggagugcaagcacuuugcccugacccacuacgccgcccagcccggcggcuacuacaacgggacgcgggaggaccgcaacaagcugcggcaucucaucucggucaagcugggcaagauccccaccguggagaacuccaucuuccacauggccgccuggagcggguccgccugccacgauggccgcgaguggaccuacaucgggguggacggccccgacagcaacgcgcuggucaagaucaaguacggcgaggccuauaccgacacguaccacuccuacgccaacaacauccuccggacccaggagagcgccuguaacugcaucgggggcgacugcuaccugaugaucaccgacgggucggccuccggcaucaguaagugccgcuuccugaagauccgggagggccgcaucaucaaggagaucuucccgaccgggcggguggagcacacggaggagugcacgugcggcuuugcguccaacaagaccaucgagugcgccugccgcgacaacagcuacaccgccaagcggcccuuugugaagcucaacgucgagaccgacaccgccgagauccgccugaugugcaccgagaccuaccuggacacgccccggcccgacgacggguccaucaccggcccgugugagagcaacggggacaagggccgcggcggggugaagggcggguucgugcaccagcggauggccuccaagaucggccgcugguacagucggaccauguccaagaccgagcgcauggggauggagcucuacgucaaguacgacggcgaccccuggacggacagcgacgcgcuggcccccuccggcgugauggugaguauggaggagcccgggugguacuccuucggcuucgagaucaaggacaagaagugcgacgucccgugcaucgggaucgagauggugcaugacggcgggaagaagaccuggcacagcgccgccaccgccaucuacugccugaugggcuccggccagcuccugugggacaccgugacgggggucgacauggcgcuguga

SEQ ID NO: 28817 - RNA, 1398 nt, Artificial Sequence
  derived and/or modified CDS sequence (AUadapt) from InfluenzaB__ABN50650__NA
augcugcccaguaccauccagacccucacgcuguuccugaccuccggcggggugcuccugagccuguacgucuccgcccuccugucguaccugcucuacuccgacgugcugcugaaguuuagcccgaagaucaucgcccccaccaugucccucgacugcgcgaacgccagcaacgugcaggccgucaaccacuccgccaccgaggagaugacguuucugcugcccgagcccgaguggaccuacccgcgccucucgugccagggcuccaccuuccagaaggcccugcugaucagcccccaccgguucggggaggcgaagggcaacuccgcgccccucaucauccgcgagcccuuuaucgccugcgggccgaaggagugcaagcacuucgcccugacccacuacgccgcccagcccggcggcuacuacaaugggacgcgggaggaccgcaacaagcugcggcaccucaucagcgugaaccugggcaagauccccaccguggagaacuccaucuuccacauggccgccuggaguggguccgccugccacgacggccgcgaguggaccuacaucggggucgacggccccgacagcaacgcgcugaucaagaucaaguauggcgaggccuacaccgacacguaccacuccuacgccaacaacauccuccggacccaggagucggccuguaacugcaucgggggcgacugcuaccugaugaucaccgacgggagcgccuccggcaucagcaagugucgcuuccugaagauccgggagggccgcaucaucaaggagaucuucccgaccgggcggguggagcacacggaggagugcacgugcggcuucgcguccaacaagaccaucgagugcgccugucgcgacaacucguacaccgccaagcggcccuucgugaagcucaacgucgagaccgacaccgccgagauccgccugaugugcaccgagaccuaucuggacacgccccggcccgacgacggguccaucaccggcccgugcgagagcaacggggacaagggccacggcgggaucaagggcggguuugugcaccagcgcauggccuccaagaucggccggugguacagccgcaccauguccaagaccaagcggauggggauggagcucuacgugaaguacgacggcgaccccuggacggacagugacgcgcuggcccccuccggcgucauggugagcauggaggagcccgggugguacuccuucggcuucgagaucaaggacaagaagugcgacgugccguguaucgggaucgagaugguccacgacggcgggaagaagaccuggcacagcgccgccaccgccaucuacugccugaugggcuccggccagcuccugugggacaccgugacggggguggacauggcgcuguga

SEQ ID NO: 28818 - RNA, 1398 nt, Artificial Sequence
  derived and/or modified CDS sequence (AUadapt) from InfluenzaB__ABN50661__NA
augcugcccaguaccauccagacccucacgcuguuccugaccuccggcggggugcuccugagccuguacgucuccgcccuccugucguaccugcucuacuccgacgugcugcugaaguuuagcccgaagaugaucgcccccaccaugucccucgacugcgcgaacgccagcaacgugcaggccgucaaccacuccgccaccgaggagaugacguuucugcugcccgagcccgaguggaccuacccgcgccucucgugccagggcuccaccuuccagaaggcccugcugaucagcccccaccgguucggggaggcgaagggcaacuccgcgccccucaucauccgcgagcccuuuaucgccugcgggccgaaggagugcaagcacuucgcccugacccacuacgccgcccagcccggcggcuacuacaaugggacgcgggaggaccgcaacaagcugcggcaccucaucagcgugaaccugggcaagauccccaccguggagaacuccaucuuccacauggccgccuggaguggguccgccugccacgacggccgcgaguggaccuacaucggggucgacggccccgacagcaacgcgcugaucaagaucaaguauggcgaggccuacaccgacacguaccacuccuacgccaacaacauccuccggacccaggagucggccuguaacugcaucgggggcgacugcuaccugaugaucaccgacgggagcgccuccggcaucagcaagugucgcuuccugaagauccgggagggccgcaucaucaaggagaucuucccgaccgggcggguggagcacacggaggagugcacgugcggcuucgcguccaacaagaccaucgagugcgccugucgcgacaacucguacaccgccaagcggcccuucgugaagcucaacgucgagaccgacaccgccgagauccgccugaugugcaccgagaccuaucuggacacgccccggcccgacgacggguccaucaccggcccgugcgagagcaacggggacaagggccacggcgggaucaagggcggguuugugcaccagcgcauggccuccaagaucggccggugguacagccgcaccauguccaagaccaagcggauggggauggagcucuacgugaaguacgacggcgaccccuggacggacagugacgcgcuggcccccuccggcgucauggugagcauggaggagcccgggugguacuccuucggcuucgagaucaaggacaagaagugcgacgugccguguaucgggaucgagaugguccacgacggcgggaagaagaccuggcacagcgccgccaccgccaucuacugccugaugggcuccggccagcuccugugggacaccgugacggggguggacauggcgcuguga

SEQ ID NO: 28819 - RNA, 1401 nt, Artificial Sequence
  derived and/or modified CDS sequence (AUadapt) from InfluenzaB__ABN50683__NA
augcugcccaguaccauccagacccucacgcuguuccugaccuccggcggggugcuccugagccuguacgucuccgccagccucuccuaucugcuguacagcgacauccuccugaaguucuccccgaccgagaucaccgcccccacgaugccccuggacugugcgaacgccagcaacgugcaggccgugaaccgcuccgccaccaagggcgucacccuccugcugcccgagccggaguggaccuacccccggcucaguugccccggguccacguuccagaaggcccugcugaucagcccccaccgcuucggcgagacccgggggaauuccgcgccgcucaucauccgcgagcccuucaucgccugcggccccaaggagugcaagcacuuugcccugacccacuacgccgcgcagcccggcggguacuacaacggcacccgggaggaucgcaacaagcugcggcaccucaucagcgugaagcuggggaagaucccgacgguggagaacuccaucuuccauauggccgccuggagcggcuccgccugccacgacgggcgcgaguggaccuacaucggcgucgauggccccgacucgaacgcccugcucaagaucaaguacggggaggcguauaccgacaccuaccacuccuacgccaacaauauccugcggacgcaggagagcgccugcaacugcaucggcggggacuguuaccugaugaucaccgacggcagcgccuccggcaucagcaagugccgcuuucucaagauccgggaggggcgcaucaucaaggagaucuuccccaccggccggguggagcacaccgaggagugcacgugcggguuugccuccaacaagaccaucgagugcgcgugccgcgacaacaguuacaccgccaagcggcccuucgugaagcugaacgucgagaccgacacggccgagauccgccugaugugcaccgagaccuaucucgacaccccgcggcccgacgacggcuccaucacggggcccugcgagagcaauggcgacaagggccucgggggcaucaagggcggguucgugcaccagcgcauggccuccaagaucgggcggugguacagucgcaccauguccaagaccaagcggaugggcauggagcuguacgugaaguacgacggcgaccccuggaccgacagugacgcccuggcgcuguccggggucauggugccgauggaggagcccggcugguacagcuucggguucgagaucaaggauaagaagugcgacgugcccugcaucggcaucgagaugguccacgacgggggcaagaagacguggcauuccgccgccaccgccaucuacugccugaugggcagcgggcagcuccugugggacaccgugaccggcguggacauggcccuguga

SEQ ID NO: 28820 - RNA, 1401 nt, Artificial Sequence
  derived and/or modified CDS sequence (AUadapt) from InfluenzaB__ABN50694__NA
augcugcccaguaccauccagacccucacgcuguuccugaccuccggcggggugcuccugagccuguacgucuccgccagccucuccuaucugcuguacagcgacauccuccugaaguucuccccgaccgagaucaccgcccccacgaugccccuggacugugcgaacgccagcaacgugcaggccgugaaccgcuccgccaccaagggcgucacccuccugcugcccgagccggaguggaccuacccccggcucaguugccccggguccacguuccagaaggcccugcugaucagcccccaccgcuucggcgagacccgggggaauuccgcgccgcucaucauccgcgagcccuucaucgccugcggccccaaggagugcaagcacuucgcccugacccauuacgccgcgcagcccggcggguacuacaacggcacccgggaggaucgcaacaagcugcggcaccucaucagcgugaagcuggggaagaucccgacgguggagaacuccaucuuccauauggccgccuggagcggcuccgccugccacgacgggcgcgaguggaccuacaucggcgucgauggccccgacagcaacgcccugcucaagaucaaguacggggaggcguacaccgauaccuaccacuccuacgccaacaacauccugcggacgcaggagagugccugcaacugcaucggcggggacuguuaccugaugaucaccgacggcagcgccuccggcaucagcaagugccgcuuucucaagauccgggaggggcgcaucaucaaggagaucuuccccaccggccggguggagcacaccgaggagugcacgugcggguucgccuccaauaagaccaucgagugcgcgugccgcgacaacagcuauaccgccaagcggcccuucgugaagcugaacgucgagaccgacacggccgagauccgccugaugugcaccgagaccuaccucgauaccccgcggcccgacgacggcuccaucacggggcccugcgagagcaauggcgacaagggcuccgggggcaucaagggcggguucgugcaccagcgcauggccagcaagaucgggcggugguacucccgcaccaugaguaagaccaagcggaugggcaugggccuguacgugaaguacgacggggaccccuggaccgacuccgaugcccuggcgcucagcggcgucaugguguccauggaggagccggggugguacagcuucggcuucgagaucaaggauaagaagugcgacgugcccugcaucgggaucgagaugguccacgacggcggcaagaagacguggcauuccgccgccaccgccaucuacugccugauggggagcggccagcugcucugggacaccgugaccgggguggacauggcccuguga

SEQ ID NO: 28821 - RNA, 1398 nt, Artificial Sequence
  derived and/or modified CDS sequence (AUadapt) from InfluenzaB__ABN50705__NA
augcugcccaguaccauccagacccucacgcuguuccugacccucggcggggugcugcugucccucuacgucagcgcccugcuguccuaccuccuguacucggacgugcugcucaaguuuuccccgaagaugaucgcccccaccaugagccuggacugcgcgaacgccuccaacgugcaggccgucaaccacagcgccaccgaggagaugacguuucugcuccccgagcccgaguggaccuacccgcgccuguccugccagggcucgaccuuccagaaggcccugcucaucagcccccaccgguucggggaggcgaagggcaacuccgcgccccugaucauccgcgagcccuuuaucgccugcgggccgaaggagugcaagcacuucgcccugacccacuacgccgcccagcccggcggcuacuacaaugggacgcgggaggaccgcaacaagcuccggcaccugaucuccgugaaccugggcaagauccccaccguggagaacagcaucuuccacauggccgccugguccgggagugccugccacgacggccgcgaguggaccuacaucggggucgacggccccgacuccaacgcgcucaucaagaucaaguacggcgaggccuauaccgacacguaccacagcuacgccaacaacauccugcggacccaggaguccgccugcaauugcaucgggggcgacugcuaccugaugaucaccgacgggucggccagcggcaucuccaagugccgcuuucucaagauccgggagggccgcaucaucaaggagaucuucccgaccgggcggguggagcacacggaggagugcacgugcggcuucgcgagcaacaagaccaucgagugcgccugucgcgacaacuccuacaccgccaagcggcccuucgugaagcugaacgucgagaccgacaccgccgagauccgccugaugugcaccgagaccuaccucgauacgccccggcccgacgacgggucgaucaccggcccgugcgaguccaacggggacaagggccacggcgggaucaagggcggguucgugcaucagcgcauggccagcaagaucggccggugguacucccgcaccaugagcaagaccaagcggauggggauggagcuguacgugaaguacgacggcgaccccuggacggacuccgaugcgcuggcccccucgggcgucaugguguccauggaggagcccgggugguacagcuucggcuucgagaucaaggacaagaagugcgacgugccguguaucgggaucgagaugguccacgacggcgggaagaagaccuggcacuccgccgccaccgccaucuacugccucaugggcagcggccagcugcugugggacaccgugacggggguggacauggcgcucuga

SEQ ID NO: 28822 - RNA, 1401 nt, Artificial Sequence
  derived and/or modified CDS sequence (AUadapt) from InfluenzaB__ABN50716__NA
augcugcccaguaccauccagacccucacgcuguuccugaccuccggcggggugcuccugagccuguacgucuccgccagccucuccuaucugcuguacagcggcauccuccugaaguucuccccgaccgagaucaccgcccccacgaugccccuggacugcgcgaaugccagcaacgugcaggccgugaaccgcuccgccaccaagggggucacccuccugcugcccgagccggaguggaccuacccccggcucaguugccccggcuccacguuccagaaggcccugcugaucagcccccaccgcuucggggagacccggggcaauuccgcgccgcucaucauccgcgagcccuucaucgccugcggccccaaggagugcaagcacuuugcccugacccacuacgccgcgcagcccgggggcuacuacaacgggacccgggaggaucgcaacaagcugcggcaccucaucagcgugaagcugggcaagaucccgacgguggagaacuccaucuuucacauggccgccuggagcggguccgccugccacgacggccgcgaguggaccuauaucggcgucgacgggcccgacagcaacgcccugcucaagaucaaguauggcgaggcguacaccgacaccuaccacuccuacgccaauaacauccugcggacgcaggagagcgccugcaacuguaucgggggcgacugcuaccugaugaucaccgacggcagcgccuccgggaucaguaagugccgcuuccucaagauccgggagggccgcaucaucaaggagaucuuccccaccgggcggguggagcacaccgaggaguguacgugcggcuucgccuccaacaagaccaucgagugcgcgugccgcgauaacagcuacaccgccaagcggcccuucgugaagcugaaugucgagaccgacacggccgagauccgccugaugugcaccgagaccuaccucgacaccccgcggcccgacgauggguccaucacgggccccugcgagagcaacggcgacaagggguccggcgggaucaagggcggguuugugcaccagcgcauggccagcaagaucggccggugguacucccgcaccaugagcaagaccaagcggaugggcauggggcuguacgugaaguaugacggcgaccccuggaccgacuccgacgcccuggcgcucaguggggucaugguguccauggaggagccgggcugguacagcuucggguucgagaucaaggacaagaagugugacgugcccugcaucggcaucgagaugguccacgacggcgggaagaagacguggcauuccgccgccaccgccaucuacugccugaugggcagcgggcagcugcucugggacaccgugaccggcguggacauggcccuguga

SEQ ID NO: 28823 - RNA, 1401 nt, Artificial Sequence
  derived and/or modified CDS sequence (AUadapt) from InfluenzaB__ABN50727__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccagcaacgugcaggccgugaaccgcuccgccaccaagggcgucacccuccugcugcccgagccggaguggaccuacccccggcucagcugucccggguccacguuccagaaggcccugcugaucucgccccaccgcuucggcgagaccaaggggaacuccgcgccgcucaucauccgggagcccuuuaucgccugcggccccaaggagugcaagcacuucgcccugacccacuaugccgcgcagcccggcggguacuacaacggcacccgcgaggaccggaacaagcugcgccaucucaucagcgugaagcuggggaagaucccgacgguggagaacuccaucuuccacauggccgccuggagcggcuccgccugucacgacgggcgggaguggaccuacaucggcgucgacggccccgacaguaacgcccugcucaagaucaaguacggggaggcguacaccgacaccuaccauuccuacgccaacaacauccugcgcacgcaggagagcgccugcaacuguaucggcggggacugcuaccugaugaucaccgacggcagcgccuccggcaucagugagugccgguuccucaagauccgcgaggggcggaucaucaaggagaucuuccccaccggccgcguggagcacaccgaggagugcacguguggguucgccuccaacaagaccaucgagugcgcgugccgggacaauucguacaccgccaagcgccccuucgugaagcugaacgucgagaccgacacggccgagauccggcugauguguaccgagaccuaccucgacaccccgcgccccgacgacggcuccaucacggggcccugcgagaguaacggcgacaagggcuccgggggcaucaagggcggguucgugcaccagcggauggccagcaagaucgggcgcugguauucccggaccaugagcaagaccaagcgcaugggcaugggccuguacgugaaguacgacggggaccccuggaccgauuccgacgcccuggcgcucagcggcgucaugguguccauggaggagccggggugguacagcuucggcuuugagaucaaggacaagaagugcgacgugcccugcaucgggaucgagaugguccacgauggcggcaagaagacguggcacuccgccgccaccgccaucuacugccugauggggagcggccagcugcucugggacaccgugaccgggguggacauggcccuguga

SEQ ID NO: 28824 - RNA, 1401 nt, Artificial Sequence; identical to SEQ ID NO: 28766
  derived and/or modified CDS sequence (AUadapt) from InfluenzaB__ABN50738__NA

SEQ ID NO: 28825 - RNA, 1401 nt, Artificial Sequence
  derived and/or modified CDS sequence (AUadapt) from InfluenzaB__ABN50749__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccagcaacgugcaggccgugaaccgcuccgccaccaagggcgucacccuccugcugcccgagccggaguggaccuacccccggcucucgugccccggguccacguuucagaaggcccugcugaucagcccccaccgcuucggcgagaccaaggggaacuccgcgccgcucaucauccgggagcccuucaucgccuguggccccaaggagugcaagcacuucgcccugacccacuacgccgcgcagcccggcggguacuauaacggcacccgcggggaccggaacaagcugcgccaccucaucagcgugaagcugggcaagaucccgacgguggagaauuccaucuuccacauggccgccuggagcggguccgccugccacgauggcaaggaguggaccuacaucggcgucgacgggcccgacagcaacgcccugcucaagaucaaguacggcgaggcguauaccgacaccuaccacuccuacgccaacaauauccugcggacgcaggagucggccugcaacugcaucgggggcaacugcuaucugaugaucaccgacggcagcgccuccgggaucagcgagugccgcuuccucaagauccgggagggccgcaucaucaaggagaucuuucccaccgggcgggugaagcacaccgaggagugcacgugcggcuucgccuccaacaagaccaucgagugcgcgugucgcgacaacagcuacaccgccaagcggcccuucgugaagcugaaugucgagaccgacacggccgagauccgccugaugugcaccgagaccuaccucgacaccccgcggcccgacgauggguccaucacgggccccugcgagagcaacggcgacaagggguccggcgggaucaagggcggguucgugcaccagcgcauggccaguaagaucggccggugguacucccgcaccaugagcaagaccaagcggaugggcauggggcuguacgugaaguacgacggcgaucccugggccgacuccgacgcgcuggcccucagcggggucaugguguccauggaggagccgggcugguacagcuucggguuugagaucaaggacaagaagugcgacgugcccugcaucggcaucgagaugguccacgauggcgggaaggagaccuggcacuccgccgccacggccaucuacugccugaugggcagcgggcagcugcucugggacaccgugaccggcguggacauggcgcuguga

SEQ ID NO: 28826 - RNA, 1398 nt, Artificial Sequence
  derived and/or modified CDS sequence (AUadapt) from InfluenzaB__ABN51188__NA
augcugcccaguaccauccagacccucacgcuguuccugaccuccggcggggugcuccugagccuguacgucuccgcccuccugagcuaccugcucuacuccgacauccugcugaaguuuucgccgaagaucaucgcccccaccaugcuccuggacugcgcgaacgccuccaacgugcaggccgugaaccacagugccaccaaggagaugacguuccugcuccccgagcccgaguggaccuacccgcgccuguccugccagggcagcaccuuccagaaggcccugcucaucucgccccaccgguuuggggaggcgaagggcaacuccgcgccccugaucauccgcgagcccuucaucgccugcgggccgaaggagugcaagcacuucgcccugacccacuacgccgcccagcccggcggcuauuacaacgggacgcgggaggaccgcaacaagcuccggcaccugaucuccgucaaccugggcaagauccccaccguggagaacaguaucuuccacauggccgccugguccgggagcgccugccacgacggccgcgaguggaccuacaucgggguggauggccccgacuccaacgcgcucaucaagaucaaguacggcgaggccuacaccgacacguaccacaguuacgccaacaacauccugcggacccaggaguccgccugcaacugcaucgggggcgacugcuaucugaugaucaccgacgggagcgccagcggcaucuccaagugccgcuuccucaagauccgggagggccgcaucaucaaggagaucuucccgaccgggcgggucgagcacacggaggaguguacgugcggcuucgcgucgaacaagaccaucgagugcgccugccgcgacaauuccuacaccgccaagcggcccuucgugaagcugaacguggagaccgacaccgccgagauccgccugaugugcaccgagaccuaccucgacacgccccggcccgaugacgggagcaucaccggcccgugcgaguccaacggggacaagggccgcggcggggucaagggcggguucgugcaccagcggauggccagcaagaucggccgcugguauucccggaccaugucgaagaccgagcgcauggggauggagcuguacgugaaguacgacggcgaccccuggacggacuccgacgcgcuggcccccaguggcgucaugguguccauggaggagcccgggugguacagcuucggcuucgagaucaaggacaagaagugcgacgugccguguaucgggaucgagaugguccacgacggcgggaagaagaccuggcacuccgccgccaccgccaucuacugccucaugggcagcggccagcugcugugggacaccgugacggggguggacauggcgcucuga

SEQ ID NO: 28827 - RNA, 1398 nt, Artificial Sequence; identical to SEQ ID NO: 28815
  derived and/or modified CDS sequence (AUadapt) from InfluenzaB__ABN51199__NA

SEQ ID NO: 28828 - RNA, 1401 nt, Artificial Sequence
  derived and/or modified CDS sequence (AUadapt) from InfluenzaB__ABN58665__NA
augcugcccaguaccauccagacccucacgcuguuccugaccuccggcggggugcuccugagccuguacgucuccgcccuccugucguaccugcucuacuccgacauccugcugaaguucaguccgaccaagaucaucgcccccaccaugucccucgacugcgcgaacgccagcaacgugcaggccgugaaccacuccgccacggaggagaugaccuuccugcugcccgagcccgaguggaccuacccgcgccucaguugccagggcuccaccuuccagaaggcccugcugaucagcccccaccgguucggggaggcgaagggcaacuccgcgccccucaucauccgcgagcccuucaucgccugcgggccgaaggaguguaagcacuucgcccugacgcacuacgccgcccagcccggcggcuacuacaacgggacccgggaggaccgcaacaagcugcggcaucucaucucggucaaccugggcaagauccccaccguggagaacuccaucuuccacauggccgccuggagcggguccgccugccacgauggccgcgaguggaccuacaucgggguggacggccccgacagcaacgcgcugaucaagaucaaguacggcgaggccuacacggacaccuaccauuccuacgccaacaacauccuccggacccaggagucggccugcaacugcaucgggggcgacuguuaccugaugaucaccgacgggagcgccuccggcaucucgaagugccgcuuccugaagauccgggagggccgcaucaucaaggagaucuucccgacggggcgggucgagcacaccgaggagugcacguguggcuucgcguccaacaagaccaucgagugcgccugccgcgacaacagcuacaccgccaagcggcccuuugugaagcucaacguggagaccgacaccgccgagauccgccugaugugcaccgagacguaccuggacacgccccggcccgacgacggguccaucaccggcccgugcgagagcaaugggggcaagggcuccgggggcaucaagggcggguucguccaccagcgcauggccucgaagaucgggcggugguacucccgcaccaugagcaagaccaagcggaugggcauggagcucuacgugaaguacgacggcgaucccuggaccgacuccgacgcgcuggcccccucgggggugauggucuccauggaggagcccggcugguacagcuucggguucgagaucaaggacaagaagugcgaugugccgugcaucggcaucgagauggugcacgacgggggcaagaagaccuggcacuccgccgccaccgccaucuacugccugaugggcagcgggcagcuccugugggacacggucaccggcguggacauggcgcuguga

SEQ ID NO: 28829 - RNA, 1401 nt, Artificial Sequence; identical to SEQ ID NO: 28716
  derived and/or modified CDS sequence (AUadapt) from InfluenzaB__ABN59449__NA

SEQ ID NO: 28830 - RNA, 1398 nt, Artificial Sequence; identical to SEQ ID NO: 28794
  derived and/or modified CDS sequence (AUadapt) from InfluenzaB__ABR15999__NA

SEQ ID NO: 28831 - RNA, 1401 nt, Artificial Sequence; identical to SEQ ID NO: 28823
  derived and/or modified CDS sequence (AUadapt) from InfluenzaB__ABR16010__NA

SEQ ID NO: 28832 - RNA, 1401 nt, Artificial Sequence
  derived and/or modified CDS sequence (AUadapt) from InfluenzaB__ABR16021__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccgcuccgccaccaagggcgucacccuccugcugcccgagccggaguggaccuacccccggcucagcugccccggguccacguuccagaaggcccugcugaucagcccccaucgcuucggcgagaccaaggggaacuccgcgccgcucaucauccgggagcccuucaucgccugcggccccaacgagugcaagcacuuugcccugacccacuacgccgcgcagcccggcggguacuacaacggcacccgcggggaccggaauaagcugcgccaccucaucucggugaagcugggcaagaucccgacgguggagaacuccaucuuccacauggccgccuggagcggguccgccugucacgacggcaaggaguggaccuacaucggcgucgacgggcccgacaacaacgcccugcucaagaucaaguauggcgaggcguacaccgacaccuaccacagcuacgccaauaagauccugcggacgcaggaguccgccugcaacugcaucgggggcaacugcuaccugaugaucaccgauggcagcgccucggggguguccgagugccgcuuccucaagauccggaagggccgcaucaucaaggagaucuuccccaccgggcgggugaagcacaccgaggaguguacgugcggcuucgccagcaacaagaccaucgagugcgcgugccgcgacaauuccuacaccgccaagcggcccuucgucaagcugaacguggagaccgacacggccgagauccgccugaugugcaccgacaccuaucucgacaccccgcggcccgacgacgggagcaucacgggccccugcgaguccaacggcgauaaggggagcggcgggaucaagggcggguucgugcaccagcgcauggccuccaagaucggccggugguacucgcgcaccauguccaagaccgagcggaugggcauggggcuguacgucaaguacgauggcgaccccugggccgacagcgacgcgcuggccuucuccggggugauggugagcaugaaggagccgggcugguauuccuucggguucgagaucaaggacaagaagugcgacguccccugcaucggcaucgagauggugcaugacggcgggaaggagaccuggcacagcgccgccacggccaucuacugccucaugggcuccgggcagcugcugugggacaccgugaccggcgucgacauggcgcucuga

SEQ ID NO: 28833 - RNA, 1401 nt, Artificial Sequence; identical to SEQ ID NO: 28748
  derived and/or modified CDS sequence (AUadapt) from InfluenzaB__ACA64903__NA

SEQ ID NO: 28834 - RNA, 1401 nt, Artificial Sequence
  derived and/or modified CDS sequence (AUadapt) from InfluenzaB__ACA64914__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaaugccagcaacgugcaggccgugaaccgcuccgccgccaagggcgucacgcuccugcugcccgagcccgaguggaccuacccgcggcucagcugucccggguccaccuuccagaaggcgcugcugaucagcccccaccgcuucggcgagaccaaggggaacuccgcgccccucaucauccgggagccguuuaucgccugcggccccacggagugcaagcacuucgcccugacccacuaugccgcccagcccggcggguacuacaacggcacccgcgaggaccggaacaagcugcgccaucucaucagcgugaagcuggggaagauccccaccguggagaacuccaucuuccacauggccgccuggagcggcuccgccugucacgacgggaaggaguggacguacgucggcguggacggcccggacaguaacgcgcugcucaagaucaaguacggggaggccuacaccgacaccuaccauuccuacgccaagaacauccugcggacccaggagagcgccugcaacuguaucggcggggacugcuaccugaugaucacggacggccccgccagcggcaucuccgagugucgcuuccucaagauccgggaggggcgcaucaucaaggagaucuuccccaccggccgggugaagcacaccgaggagugcacgugcggguuugcgagcaacaagaccaucgagugcgccugccgcgacaauuccuacaccgccaagcggcccuucgucaagcugaacguggagaccgacaccgccgagauccgccugaugugcacggagaccuaucucgacaccccgcggcccaacgacggcagcaucaccgggcccugcgaguccgauggcgacaagggcagcgggggcaucaagggcggguucgugcaccagcgcauggccuccaagaucgggcggugguacagucgcacgauguccaagaccaagcggaugggcaugggccuguacgucaaguacgacggggaccccuggaccgacagugaggcgcuggcccucuccggcgugauggugagcauggacgagccggggugguacuccuucggcuucgagaucaaggauaagaagugcgacguccccugcaucgggaucgagauggugcacgacggcggcaagaccacguggcauagcgccgccaccgccaucuacugccugaugggguccggccagcugcucugggacaccgugaccggggucgacauggcgcuguga

SEQ ID NO: 28835 - RNA, 1401 nt, Artificial Sequence; identical to SEQ ID NO: 28748
  derived and/or modified CDS sequence (AUadapt) from InfluenzaB__ACA64936__NA

SEQ ID NO: 28836 - RNA, 1401 nt, Artificial Sequence
  derived and/or modified CDS sequence (AUadapt) from InfluenzaB__ACA64969__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccgccaagggcgucacccuccugcugcccgagccggaguggaccuacccccggcucagcugccccggguccaccuuucagaaggcgcugcugaucucgccccaccgcuucggcgagacgaaggggaacuccgccccgcucaucauccgggagcccuucaucgccugcggccccaaugagugcaagcacuucgcccugacccacuacgcggcccagcccggcggguauuacaacggcacccgcggggaccggaacaagcugcgccaccucaucagcgugaagcugggcaagaucccgaccguggagaauuccaucuuccacauggccgccuggagcggguccgccugccacgauggcaaggaguggacguacaucggcgucgacgggcccgacaacaacgcgcugcucaagaucaaguacggcgaggccuauaccgacaccuaccacagcuacgccaauaagauccugcggacccaggaguccgccugcaacugcaucgggggcaacugcuaccugaugaucacggauggcagcgccagcgggguguccgagugccgcuuccucaagauccgggagggccgcaucaucaaggagaucuuccccaccgggcgggugaagcauaccgaggagugcacgugcggcuucgcgucgaacaagaccaucgagugcgccugucgcgacaacuccuacaccgccaagcggcccuucgucaagcugaacguggagaccgauaccgccgagauccgccugaugugcacggacaccuaccucgacaccccgcggcccgacgacgggaguaucaccggccccugcgaguccaacggcgacaaggggagcggcgggaucaagggcggguucgugcaucagcgcauggccuccaagaucggccggugguacagccgcacgauguccaagaccgagcggaugggcauggggcuguacgucaaguacgacggcgaccccugggcggauagcgacgcccuggccuucuccggggugauggugagcaugaaggagccgggcugguacuccuuuggguucgagaucaaggacaagaagugcgacguccccugcaucggcaucgagauggugcacgauggcgggaaggagaccuggcacagcgccgccaccgcgaucuacugccucaugggcuccgggcagcugcugugggacacggugaccggcgucgacauggcccucuga

SEQ ID NO: 28837 - RNA, 1401 nt, Artificial Sequence
  derived and/or modified CDS sequence (AUadapt) from InfluenzaB__ACA64980__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugagccuggacugcgcgaaugccuccaacgugcaggccgugaaccgcagcgccaccaagggcgucacccuccugcugcccgagcccgaguggaccuacccgcggcucuccugccccgggucgacguuucagaaggcccugcugaucagcccccaccgcuucggcgagaccaaggggaacuccgcgccccucaucauccgggagccguucaucgccugcggccccaaugagugcaagcacuucgcccugacccacuacgccgcgcagcccggcggguacuauaacggcacccgcggggaccggaacaagcugcgccaccucaucuccgugaagcugggcaagauccccacgguggagaacagcaucuuucacauggccgccugguccgggagcgccugccacgacggcaaggaguggaccuacaucggcgucgaugggccggacaacaacgcccugcucaagaucaaguacggcgaggcguacaccgacaccuaucacuccuacgccagcaagauccugcggacgcaggagagcgccugcaacuguaucgggggcaacugcuaccugaugaucaccgacggcuccgccagcgggguguccgagugucgcuuccucaagauccgggagggccgcaucaucaaggagaucuuccccaccgggcgggugaagcacaccgaggagugcacgugcggcuucgccaguaacaagaccaucgagugcgcgugccgcgacaacuccuacaccgccaagcggcccuuugucaagcugaacguggagaccgacacggccgagauccgccugaugugcaccgacaccuaccucgacacgccccggccggaugacgggagcaucaccggccccugcgaguccaacggcgacaaggggagcggcgggaucaagggcggguuugugcaccagcgcauggccuccaagaucggccggugguacagccgcaccauguccaagaccgagcggaugggcauggggcuguacgucaaguacgacggcgaucccugggccgacagcgacgcgcuggccuucuccggggugauggugagcaugaaggagcccggcugguacuccuuuggguucgagaucaaggacaagaagugcgacgucccgugcaucggcaucgagauggugcacgauggcgggaaggagaccuggcacagcgccgccacggccaucuacugccucaugggcuccgggcagcugcugugggacaccgugaccggcgucgacauggcgcucuga

SEQ ID NO: 28838 - RNA, 1401 nt, Artificial Sequence
  derived and/or modified CDS sequence (AUadapt) from InfluenzaB__ACA64991__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcacgccgugaaccgcuccgccaccaagggcgucacccuccugcugcccgagccggaguggaccuacccccggcucagcugucccggguccacguuccagaaggcccugcugaucagcccccaccgcuucggcgagaccaaggggaacuccgcgccgcucaucauccgggagcccuucaucgccuguggccccaacgagugcaagcacuucgcccugacccacuacgccgcgcagcccggcggguauuacaacggcacccgcggggaccggaacaagcugcgccaccucaucagugugaagcugggcaagaucccgacgguggagaacuccaucuuccacauggccgccuggagcggguccgccugccacgauggcaaggaguggaccuacaucggcgucgacgggcccgacaacaacgcccugcucaagaucaaguacggcgaggcguauaccgacaccuaccacucguacgccaauaacauccugcggacgcaggaguccgccugcaacugcaucgggggcaacugcuaucugaugaucaccgacggcagcgccagcgggguguccgagugccgcuuccucaagauccgggagggccgcaucaucaaggagaucuuucccaccgggcgggugaagcacaccgaggagugcacgugcggcuucgccagcaacaagaccaucgagugugcgugccgcgacaacuccuacaccgccaagcggcccuucgucaagcugaacguggagaccgauacggccgagauccgccugaugugcaccgacaccuaccucgacaccccgcggcccgacgaugggagcaucacgggccccugcgaguccaacggcgacaaggggucgggcgggaucaagggcggguucgugcaucagcgcauggccuccaagaucggccggugguacagccgcaccauguccaagaccgagcggaugggcauggggcuguacgucaaguacgacggcgaccccugggccgauagcgacgcgcuggccuucgggggcgugaugguguccaugaaggagccggggugguacagcuuuggcuucgagaucaaggacaagaagugcgacguccccugcaucggcaucgagauggugcacgaugggggcaaggagaccuggcacuccgccgccacggccaucuacugccucauggggagcggccagcugcugugggacaccgugaccggcgucgacauggcgcucuga

SEQ ID NO: 28839 - RNA, 1401 nt, Artificial Sequence; identical to SEQ ID NO: 28748
  derived and/or modified CDS sequence (AUadapt) from InfluenzaB__ACA65013__NA

SEQ ID NO: 28840 - RNA, 1401 nt, Artificial Sequence; identical to SEQ ID NO: 28748
  derived and/or modified CDS sequence (AUadapt) from InfluenzaB__ACA65024__NA

SEQ ID NO: 28841 - RNA, 1401 nt, Artificial Sequence
  derived and/or modified CDS sequence (AUadapt) from InfluenzaB__ACA65035__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuucagaaggcccugcugaucucgccccaccgcuucggcgagaccaaggggaacuccgcgccgcucaucauccgggagcccuucaucgccugcggccccaaugagugcaagcacuucgcccugacccacuacgccgcgcagcccggcggguauuacaacggcacccgcggggaccggaacaagcugcgccaccucaucagcgugaagcugggcaagaucccgacgguggagaauuccaucuuccacauggccgccuggagcggguccgccugccacgauggcaaggaguggaccuacaucggcgucgacgggcccgacaacaacgcccugcucaagaucaaguacggcgaggcguauaccgacaccuaccacagcuacgccuccaagauccugcggacgcaggagagugccugcaacugcaucgggggcaacugcuaccugaugaucaccgauggcagcgccuccggggugagcgagugccgcuuccucaagauccgggagggccgcaucaucaaggagaucuuccccaccgggcgggugaagcauaccgaggagugcacgugcggcuucgccuccaacaagaccaucgagugcgcgugccgcgauaacucguacaccgccaagcggcccuucgucaagcugaacguggagaccgauacggccgagauccgccugaugugcaccgacaccuaccucgacaccccgcggcccgacgacggguccaucacgggccccugugagagcaacggcgacaagggguccggcgggaucaagggcggguucgugcaccagcgcauggccaguaagaucggccggugguacucccgcaccaugagcaagaccgagcggaugggcauggggcuguacgucaaguacgacggcgaccccugggccgauuccgacgcgcuggccuucagcggggugaugguguccaugaaggagccgggcugguacagcuuuggguucgagaucaaggacaagaagugcgacguccccugcaucggcaucgagauggugcacgauggcgggaaggagaccuggcacuccgccgccacggccaucuacugccucaugggcagcgggcagcugcugugggacaccgugaccggcgucgacauggcgcucuga

SEQ ID NO: 28842 - RNA, 1401 nt, Artificial Sequence; identical to SEQ ID NO: 28748
  derived and/or modified CDS sequence (AUadapt) from InfluenzaB__ACA65046__NA

SEQ ID NO: 28843 - RNA, 1401 nt, Artificial Sequence
  derived and/or modified CDS sequence (AUadapt) from InfluenzaB__ACA65057__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaacgaguguaagcacuucgcccugacccacuacgccgcgcagcccggcggguacuacaauggcacccgcggggaccggaacaagcugcgccaccucaucagcgugaagcugggcaagaucccgacgguggagaacuccaucuuccauauggccgccuggagcggguccgccugccacgacggcaaggaguggaccuacaucggcgucgacgggcccgauaacaacgcccugcucaagaucaaguacggcgaggcguacaccgacaccuaccauagcuacgccaacaagauccugcggacgcaggaguccgccugcaacugcaucgggggcaauugcuaccugaugaucaccgacggcagcgccagcgggguguccgagugccgcuuucucaagauccgggagggccgcaucaucaaggagaucuuccccaccgggcgggugaagcacaccgaggagugcacgugcggcuucgccucgaauaagaccaucgagugcgcgugccgcgacaacuccuacaccgccaagcggcccuucgucaagcugaauguggaggccgacaccgccgagauccgccugaugugcacggacaccuaccucgacaccccgcggcccgacgaugggagcaucaccggccccugcgaguucaacggcgacaagggguccggcgggaucaagggcggguucgugcaucagcgcauggccagcaagaucggccggugguacucccgcacgaugagcaagaccgagcggaugggcauggggcuguacgucaaguacgacggcgaucccugggcggacuccgacgcccuggccuucagcggggugaugguguccaugaaggagccgggcugguacagcuuuggguucgagaucaaggacaagaagugcgacguccccugcaucggcaucgagauggugcacgauggcgggaaggagaccuggcacuccgccgccaccgcgaucuacugccucaugggcagcgggcagcugcugugggacacggugaccggcgucgacauggcccucuga

SEQ ID NO: 28844 - RNA, 1401 nt, Artificial Sequence; identical to SEQ ID NO: 28748
  derived and/or modified CDS sequence (AUadapt) from InfluenzaB__ACA65068__NA

SEQ ID NO: 28845 - RNA, 1401 nt, Artificial Sequence; identical to SEQ ID NO: 28748
  derived and/or modified CDS sequence (AUadapt) from InfluenzaB__ACA65079__NA

SEQ ID NO: 28846 - RNA, 1401 nt, Artificial Sequence; identical to SEQ ID NO: 28748
  derived and/or modified CDS sequence (AUadapt) from InfluenzaB__ACA65090__NA

SEQ ID NO: 28847 - RNA, 1401 nt, Artificial Sequence; identical to SEQ ID NO: 28748
  derived and/or modified CDS sequence (AUadapt) from InfluenzaB__ACA65101__NA

SEQ ID NO: 28848 - RNA, 1401 nt, Artificial Sequence
  derived and/or modified CDS sequence (AUadapt) from InfluenzaB__ACA96567__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccucgaaugugcacgccgugaaccgcuccgccaccaagggcgucacccuccugcugcccgagccggagugggccuacccccggcucagcugccccggguccaccuuccagaaggcgcugcugaucaguccccaccgcuucggcgagacgaaggggaacuccgccccgcucaucauccgggagcccuucaucgccugcggccccaacgaguguaagcacuucgcccugacccacuacgcggcccagcccggcggguacuacaauggcacccgcggggaccggaacaagcugcgccaccucaucagcgugaagcugggcaagaucccgaccguggagaacuccaucuuccauauggccgccuggagcggguccgccugccacgacggcaaggaguggacguacaucggcgucgacgggcccgauaacaacgcgcugcucaagaucaaguacggcgaggccuacaccgacaccuaccauucguacgccaacaacauccugcggacccaggaguccgccugcaacuguaucgggggcaacugcuaccugaugaucacggacggcagcgccagcgggguguccgagugucgcuuccucaagauccgggagggccgcaucaucaaggagaucuuccccaccgggcgggugaagcacaccgaggagugcacgugcggcuucgcgaguaacaagaccaucgagugcgccugccgcgacaacuccuacaccgccaagcggcccuuugucaagcugaacguggagaccgacaccgccgagauccgccugaugugcacggacaccuaccucgacaccccgcggcccgaugacgggagcaucaccggccccugcgaguccaacggcgacaaggggucgggcgggaucaagggcggguuugugcaccagcgcauggccuccaagaucggccggugguacagccgcacgauguccaagaccgagcggaugggcauggggcuguacgucaaguacgacggcgaucccugggcggacagcgacgcccuggccuucuccgggaucauggugagcaugaaggagccgggcugguacuccuuuggguucgagaucaaggacaagaagugcgacgugcccugcaucggcaucgagaugguccacgauggcgggaaggagaccuggcacagcgccgccaccgcgaucuacugccucaugggcuccgggcagcugcugugggacacggugaccggcguggacauggcccucuga

SEQ ID NO: 28849 - RNA, 1401 nt, Artificial Sequence; identical to SEQ ID NO: 28748
  derived and/or modified CDS sequence (AUadapt) from InfluenzaB__ACA96578__NA

SEQ ID NO: 28850 - RNA, 1401 nt, Artificial Sequence; identical to SEQ ID NO: 28836
  derived and/or modified CDS sequence (AUadapt) from InfluenzaB__ACA96589__NA

SEQ ID NO: 28851 - RNA, 1401 nt, Artificial Sequence; identical to SEQ ID NO: 28748
  derived and/or modified CDS sequence (AUadapt) from InfluenzaB__ACA96600__NA

SEQ ID NO: 28852 - RNA, 1401 nt, Artificial Sequence
  derived and/or modified CDS sequence (AUadapt) from InfluenzaB__ACA96611__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacuacgcgaacgccagcaaugugcacgccgugaaccacuccgccaccaagggcgucacccuccugcugcccgagccggaguggaccuacccccgccucagcugccccggguccacguuccagaaggcccugcugaucaguccccaccgguucggcgagaccaaggggaacuccgcgccgcucaucauccgcgagcccuucaucgccugcggccccaacgaguguaagcacuucgcccugacccacuacgccgcgcagcccggcggguacuacaacggcacccgcggggaucggaacaagcugcggcaccucaucucggugaagcugggcaagaucccgacgguggagaacuccaucuuccacauggccgccuggaguggguccgccugccacgacggcaaggaguggaccuacaucggcgucgacgggcccgacaacaaugcccugcucaagaucaaguacggcgaggcguacaccgacaccuaccacagcuaugccaacaacauccugcgcacgcaggaguccgccugcaacugcaucgggggcaacugcuaucugaugaucaccgacggcagcgccucggggguguccgagugccgguuccucaagauccgcgagggccggaucaucaaggagaucuuccccaccgggcgcgugaagcauaccgaggagugcacgugcggcuucgccagcaacaagaccaucgagugcgcgugccgggauaacuccuacaccgccaagcgccccuucgucaagcugaacguggagaccgacacggccgagauccggcugaugugcaccgauaccuaccucgacaccccgcgccccgacgacgggagcaucacgggccccugcgaguccaacggcgauaaggggagcggcgggaucaagggcggguucgugcaccagcggauggccuccaagaucggccgcugguacucgcggaccauguccaagaccgagcgcaugggcauggggcuguacgucaaguaugacggcgaccccugggccgacagcgacgcgcuggccuucuccggggugauggugagcaugaaggagccgggcugguauuccuucggguucgagaucaaggacaagaagugcgacguccccugcaucggcaucgagauggugcaugacggcgggaaggagaccuggcacagcgccgccacggccaucuacugccucaugggcuccgggcggcugcugugggacaccgugaccggcgucgacauggcgcucuga

SEQ ID NO: 28853 - RNA, 1401 nt, Artificial Sequence
  derived and/or modified CDS sequence (AUadapt) from InfluenzaB__ACA96622__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccucgaaugugcacgccgugaaccgcuccgccaccaagggcgucacccuccugcugcccgagccggaguggaccuacccccggcucagcugccccggguccacguuccagaaggcccugcugaucagcccccaucgcuucggcgagaccaaggggaacuccgcgccgcucaucauccgggagcccuucaucgccugcggccccaacgagugcaagcauuucgcccugacccacuacgccgcgcagcccggcggguacuacaacggcacccgcggggaccggaauaagcugcgccaccucaucagcgugaagcugggcaagaucccgacgguggagaacuccaucuuccacauggccgccuggagcggguccgccugucacgacggcaaggaguggaccuacaucggcgucgacgggcccgacaacaaugcccugcucaagaucaaguacggcgaggcguacaccgacaccuaccacucguacgccaauaacauccugcggacgcaggaguccgccugcaacugcaucgggggcaacugcuaucugaugaucaccgacggcagcgccagcgggguguccgagugccgcuuccucaagauccgggagggccgcaucaucaaggagaucuuccccaccgggcgggugaagcacaccgaggaguguacgugcggcuucgccagcaacaagaccaucgagugcgcgugccgcgauaacuccuacaccgccaagcggcccuucgucaagcugaacguggagaccgacacggccgagauccgccugaugugcaccgauaccuaccucgacaccccgcggcccgacgacgggagcaucaucggccccugcgaguccaacggcgauaaggggucgggcgggaucaagggcggguucgugcaccagcgcauggccuccaagaucggccggugguacagccgcacgauguccaagaccgagcggaugggcauggggcuguacgucaaguaugacggcgaccccugggccgacagcgacgcgcuggccuucuccggggugauggugagcaugaaggagccgggcugguauuccuucggguucgagaucaaggacaagaagugcgacguccccugcaucggcaucgagauggugcaugacggcgggaaggagaccuggcacagcgccgccaccgccaucuacugccucaugggcuccgggcagcugcugugggacacggugaccggcgucgacauggcgcucuga

SEQ ID NO: 28854 - RNA, 1401 nt, Artificial Sequence; identical to SEQ ID NO: 28836
  derived and/or modified CDS sequence (AUadapt) from InfluenzaB__ACA96633__NA

SEQ ID NO: 28855 - RNA, 1401 nt, Artificial Sequence
  derived and/or modified CDS sequence (AUadapt) from InfluenzaB__ACA96644__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaacgugcaggccgugaaucgcuccgccaccaagggcgucacccuccugcugcccgagccggaguggaccuacccccggcucagcugccccggguccacguuccagaaggcccugcugaucucgccccaccgcuucggcgagaccaaggggaauuccgcgccgcucaucauccgggagcccuucaucgccugcggccccaacgagugcaagcacuucgcccugacccacuaugccgcgcagcccggcggguacuacaacggcacccgcggggaccggaacaagcugcgccaccucaucaguaucaagcugggcaagaucccgacgguggagaacuccaucuuccacauggccgccuggagcggguccgccugccacgacggcaaggaguggaccuauaucggcguggacgggcccgacaacaacgcccugcucaagaucaaguacggcgaggcguacaccgacaccuaucacucguacgccaacaagauccugcggacgcaggaguccgccugcaacugcaucgggggcaauugcuaccugaugaucaccgacggcagcgccagcggggucuccgagugccgcuuucucaagauccgggagggccgcaucaucaaggagaucuuccccaccgggcgggugaagcacaccgaggagugcacgugcggcuucgccucgaacaagaccaucgagugugcgugccgcgacaacuccuacaccgccaagcggcccuucgugaagcugaacgucgagaccgacacggccgagauccgccugauguguaccgacaccuaccucgacaccccgcggcccgacgacgggagcaucacgggccccugcgaguccaauggcgacaaggggagcggcgggaucaagggcggguucgugcaccagcgcauggccuccaagaucggccggugguacucgcgcaccauguccaagaccgagcggaugggcauggggcuguaugugaaguacgacggcgaccccugggccgacagcgacgcgcuggccuucuccggggucaugaucaguaugaaggagccgggcugguacuccuucggguucgagaucaaggacaagaagugcgacgugcccugcaucggcaucgagauggugcaugacggcgggaaggagaccuggcacagcgccgccacggccaucuacugccucaugggcuccgggcagcugcugugggacaccgucaccggcguggacauggcgcucuga

SEQ ID NO: 28856 - RNA, 1401 nt, Artificial Sequence
  derived and/or modified CDS sequence (AUadapt) from InfluenzaB__ACA96655__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaacgccaguaacgugcaggccgugaaccgcuccgccacgaagggcgucacccuccugcugcccgagcccgaguggaccuacccgcggcucagcugccccggguccaccuuucagaaggcccugcugaucagcccccaccgcuucggcgagacgaaggggaacuccgcgccccucaucauccgggagccguucaucgccugcggccccaaggaguguaagcacuucgcccugacccacuacgccgcgcagcccggcggguacuacaauggcacccgcgaggaccggaacaagcugcgccaccucaucagcgugaagcuggggaagauccccaccguggagaacuccaucuuucacauggccgccuggagcggcuccgccugccacgacgggcgggaguggacguacaucggcgucgauggcccggacucgaacgcccugcucaagaucaaguacggggaggcguacaccgauaccuaccacuccuacgccaagaacauccugcgcacccaggagagcgccugcaauugcaucggcggggacugcuaccugaugaucacggacggccccgccagcggcaucuccgagugucgguuccucaagauccgcgaggggcggaucaucaaggagaucuuccccaccggccgcgugaagcacaccgaggagugcacgugcggguuugccagcaacaagaccaucgagugcgcgugccgggacaacuccuauaccgccaagcgccccuucgugaagcugaacgucgagaccgacaccgccgagauccggcugaugugcacggagaccuaccucgauaccccgcgccccaacgacggcagcaucaccgggcccugcgaguccaacggcgacaagggcagugggggcaucaagggcggguucgugcaccagcggauggccuccaagaucgggcgcugguacagccggacgauguccaagaccaagcgcaugggcaugggccuguacgugaaguacgauggggaccccuggaccgacagcgaggcccuggcgcucuccggcgucauggugagcauggaggagccggggugguacuccuuuggcuucgagaucaaggacaagaagugcgacgugcccugcaucgggaucgagaugguccacgauggcggcaagaccacguggcacagcgccgccaccgccaucuacugccugaugggguccggccagcugcucugggacaccgugaccgggguggacauggcccuguga

SEQ ID NO: 28857 - RNA, 1401 nt, Artificial Sequence
  derived and/or modified CDS sequence (AUadapt) from InfluenzaB__ACA96666__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaacgaguguaagcacuucgcccugacccacuacgccgcgcagcccggcggguacuacaauggcacccgcgaggaccggaacaagcugcgccaccucaucagcgugaagcuggggaagaucccgacgguggagaacuccaucuuccauauggccgccuggagcggcuccgccugccacgacgggaaggaguggaccuacaucggcgucgacggccccgauaacaacgcccugcucaagaucaaguacggggaggcguacaccgacaccuaccauucguacgccaacaagauccugcggacgcaggaguccgccugcaacugcaucggcgggaauugcuaccugaugaucaccgacggcagcgccagcggcguguccgagugccgcuuucucaagauccgggaggggcgcaucaucaaggagaucuuccccaccggccgggugaagcacaccgaggagugcacgugcggguucgccagcaauaagaccaucgagugcgcgugccgcgacaacuccuacaccgccaagcggcccuucgucaagcugaauguggagaccgacacggccgagauccgccugaugugcaccgacaccuaccucgacaccccgcggcccgacgauggcagcaucacggggcccugcgaguccaacggcgaccgcggcucggggggcaucaagggcggguucgugcaucagcggauggccuccaagaucgggcgcugguacagccggaccauguccaagaccgagcgcaugggcaugggccuguacgucaaguacgacggggaccccugggccgauagcgacgcgcuggccuucuccggcgugauggugagcaugaaggagccggggugguacuccuucggcuuugagaucaaggacaagaagugcgacguccccugcaucgggaucgagauggugcacgacgauggcaaggagaccuggcacagcgccgccacggccaucuacugccucaugggcuccgggcagcugcugugggacaccgugaccggcgucgacauggcgcucuga

SEQ ID NO: 28858 - RNA, 1401 nt, Artificial Sequence
  derived and/or modified CDS sequence (AUadapt) from InfluenzaB__ACD56581__NA
augcugcccaguaccauccagacccucacgcuguuccugaccuccggcggggugcuccugagccuguacgucuccgccucgcucuccuaccugcuguacagcgauauccuccugaaguucuccaccaccgagaucacggccccgaccaugccccuggacugcgcgaacgccagcaacgugcaggccgugaaccgcuccgccaccaagggcgucacccuccugcugcccgagcccgaguggacguauccgcggcucucgugccccggguccaccuuccagaaggcccugcugaucagcccccaccgcuucggcgagaccaaggggaacuccgcgccccucaucauccgggagccguuuaucgccugcggccccaaggagugcaagcacuucgcccugacccacuacgccgcgcagcccggcggguacuauaacggcacgcgcgaggaccggaacaagcugcgccaccucaucucggugaagcuggggaagauccccaccguggagaacuccaucuuccauauggccgccuggagcggcuccgccugccacgacgggaaggaguggaccuacaucggcgucgacggcccggacaguaacgcccugcucaagaucaaguacggggaggcguacaccgacacguaccacuccuacgccaauaacauccugcggacccaggagucggccugcaacugcaucggcgggaacugcuaccugaugaucaccgauggcagcgccuccggcaucucggagugccgcuuccucaagauccgggaggggcgcaucaucaaggagaucuuccccaccggccgggugaagcacacggaggagugcacguguggguucgccuccaacaagaccaucgagugcgcgugccgcgacaacagcuauaccgccaagcggcccuucgugaagcugaacgucgagaccgacaccgccgagauccgccugaugugcaccgagaccuaccucgacacgccccggccggacgauggcuccaucaccgggcccugcgagagcaacggcaacaagggcuccgggggcaucaagggcggguucgugcaccagcgcauggccucgaagaucgggcggugguauucccgcaccaugagcaagaccaagcggaugggcaugggccuguacgugaaguacgacggggaccccuggacggacuccgacgcccuggcgcucaguggcgucaugguguccauggaggagcccgggugguacagcuucggcuucgagaucaaggacaagaagugcgacgugccguguaucgggaucgagaugguccacgacggcggcaaggagaccuggcacuccgccgccaccgccaucuacugccugauggggagcggccagcugcucugggacaccgugacggggguggacauggcccuguga

SEQ ID NO: 28859 - RNA, 1401 nt, Artificial Sequence
  derived and/or modified CDS sequence (AUadapt) from InfluenzaB__ACF33793__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccucgaaugugcaggccgugaaccgcuccgccaccaagggcgucacccuccugcugcccgagccggaguggaccuacccccggcucagcugccccggguccacguuccagaaggcccugcugaucagcccccaccgcuuuggcgagaccaaggggaacuccgcgccgcucaucauccgggagcccuucaucgccugcggccccaacgagugcaagcacuuugcccugacccacuacgccgcgcagcccggcggguacuacaacggcacccgcggggaccggaauaagcugcgccaccucaucagcgugaagcugggcaagaucccgacgguggagaacuccaucuuccacauggccgccuggagcggguccgccugccaugacggcaaggaguggaccuacaucggcgucgacgggcccgacaacaacgcccugcucaagaucaaguauggcgaggcguacaccgacaccuaccacucguacgccaauaacauccugcggacgcaggaguccgccugcaacugcaucgggggcaacugcuaccugaugaucaccgauggcagcgccagcgggguguccgagugccgcuuccucaagauccgggagggccgcaucaucaaggagaucuuccccaccgggcgggugaagcacaccgaggaguguacgugcggcuucgccagcaacaagaccaucgagugcgcgugccgcgauaacuccuacaccgccaagcggcccuucgucaagcugaacguggagaccgacacggccgagauccgccugaugugcaccgacaccuaucucgacaucccgcggcccgacgacgggagcaucaccggccccugcgaguccaacggcgauaaggggucgggcgggaucaagggcggguucgugcaccagcgcauggccuccaagaucggccggugguacagccgcacgauguccaagaccgagcggaugggcauggggcuguacgucaaguaugacggcgaccccugggccgacagcgacgcgcuggccuucuccggggugauggugagcaugaaggagccgggcugguauuccuucggguucgagaucaaggacaagaagugcgacguccccugcaucggcaucgagauggugcaugacggcgggaaggagaccuggcacagcgccgccaccgccaucuacugccucaugggcuccgggcagcugcugugggacacggugaccggcgucgacauggcgcucuga

SEQ ID NO: 28860 - RNA, 1401 nt, Artificial Sequence
  derived and/or modified CDS sequence (AUadapt) from InfluenzaB__ACF33795__NA
augcugcccaguaccauccagacccucacgcuguuccugaccuccggcggggugcuccugagccuguacgucuccgccucgcucuccuaccugcuguacagcgauauccuccugaaguucccguccaccgagaucaccgcccccacgaugccccuggacugcgcgaacgccucgaacgugcaggccgugaaccgcuccgccaccaagggcgucacccuccugcugcccgagccggaguggaccuacccccggcucaguugccccggguccacguuccagaaggcccugcugaucagcccccaccgcuucggcgagaccaaggggaacuccgcgccgcucaucauccgggagcccuucaucgccugcggccccaaggaguguaagcacuucgcccugacccacuacgccgcgcagcccggcggguacuacaacggcacccgcggggaucggaacaagcugcgccaccucaucucggugaagcugggcaagaucccgacgguggagaacuccaucuuccacauggccgccuggagcggguccgccugccaugacggcaaggaguggaccuacaucggcgucgacgggcccgacaacaacgcccugcucaagaucaaguacggcgaggcguacaccgauaccuaccacucguacgccaacaacauccugcggacgcaggaguccgccugcaauugcaucgggggcaacugcuaccugaugaucaccgacggcagcgccucggggguguccgagugccgcuuucucaagauccgggagggccgcaucaucaaggagaucuuccccaccgggcggaucaagcacaccgaggagugcacgugcggcuucgccagcaacaagaccaucgagugcgcgugucgcgacaacuccuacaccgccaagcggcccuucgugaagcugaacgucgagaccgacacggccgagauccgccugaugugcaccgagaccuaccucgauaccccgcggcccgacgacgggagcaucacgggccccugcgaguccaacggcgacaaggggucgggcgggaucaagggcggguuugugcaccagcgcauggccuccaagaucggccggugguacagccgcaccauguccaagaccgagaagaugggcauggggcuguacgugaaguacgacggcgagcccugggccgacucggaugcgcugaccuucuccggggucauggugagcauggaggagccgggcugguacuccuucggguucgagaucaaggacaagaagugcgacgugcccuguaucggcaucgagaugguccacgacggcgggaaggagacguggcacagcgccgccaccgccaucuacugccucaugggcuccgggcagcugcugugggacaccgugaccggcgugaacauggcccucuga

SEQ ID NO: 28861 - RNA, 1401 nt, Artificial Sequence
  derived and/or modified CDS sequence (AUadapt) from InfluenzaB__ACF33797__NA
augcugcccaguaccauccagacccucacgcuguuccugaccuccggcggggugcuccugagccuguacgucuccgccagccucuccuaccugcuguauucggacauccuccugaaguucuccccgaccgagaucaccgcccccacgaugccccuggacugcgcgaaugccagcaacgugcaggccgugaaccgcuccgccaccaagggcgucacccuccugcugcccgagccggaguggaccuacccccggcucagcugccccggguccacguuucagaaggcccugcugaucagcccccaccgcuucggcgagaccaaggggaacuccgcgccgcucaucauccgggagcccuucaucgccuguggccccaacgagugcaagcacuucgcccugacccacuacgccgcgcagcccggcggguauuacaacggcacccgcggggaccggaacaagcugcgccaccucaucagugugaagcugggcaagaucccgacgguggagaacuccaucuuccacauggccgccuggagcggguccgccugccacgauggcaaggaguggaccuacaucggcgucgacgggcccgacaacaacgcccugcucaagaucaaguauggcgaggcguacaccgacaccuaccacagcuacgccaauaacacgcugcggacccaggaguccgccugcaacugcaucgggggcaacuguuaccugaugaucaccgacggcagcgccucggggguguccgagugccgcuuccucaagauccgggagggccgcaucaucaaggagaucuuucccaccgggcgggugaagcacacggaggagugcacgugcggcuucgccagcaauaagaccaucgagugcgcgugccgcgacaacuccuacaccgccaagcggcccuucgucaagcugaauguggagaccgacaccgccgagauccgccugaugugcaccgagaccuaccucgacacgccgcggcccgacgaugggagcaucaccggccccugcgaguccaacggcgacaaggggagcggcgggaucaagggcggguucgugcaucagcgcauggccuccaagaucggccggugguacucgcgcaccauguccaagaccgagcggaugggcauggggcuguacgucaaguacgacggcgaucccugggccgacagcgacgcgcuggcccucaucggggugaugguguccauggaggagccgggcugguacagcuucggguuugagaucaaggacaagaagugcgacguccccugcaucggcaucgagauggugcacgauggcgggaaggagacguggcacuccgccgccaccgccaucuacugccugaugggcagcgggcagcugcucugggacaccgugaccggcgucaacauggcgcuguga

SEQ ID NO: 28862 - RNA, 1401 nt, Artificial Sequence; identical to SEQ ID NO: 28841
  derived and/or modified CDS sequence (AUadapt) from InfluenzaB__ACF41662__NA

SEQ ID NO: 28863 - RNA, 1401 nt, Artificial Sequence
  derived and/or modified CDS sequence (AUadapt) from InfluenzaB__ACF54140__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaacgaguguaagcacuucgcccugacccacuacgccgcgcagcccggcggguacuacaauggcaccaagggggaccgcaacaagcugcggcaccucaucagcgugaagcugggcaagaucccgacgguggagaacuccaucuuccauauggccgccuggagcggguccgccugccacgacggcaaggaguggaccuacaucggcgucgacgggcccgauaacaacgcccugcucaagaucaaguacggcgaggcguacaccgacaccuaccauucguacgccaacaagauccugcgcacgcaggaguccgccugcaacugcaucgggggcaauugcuaccugaugaucaccgacggcagcgccagcgggguguccgagugucgguuccucaagauccgcgagggccggaucaucaaggagaucuuccccaccgggcgcgugaagcacaccgaggagugcacgugcggcuucgccaguaacaagaccaucgagugcgcgugccgggacaacuccuacaccgccaagcgccccuuugucaagcugaacguggagaccgacacggccgagauccggcugaugugcaccgacaccuaccucgacaccccgcgccccgaugacgggagcaucacgggccccugcgaguccaacggcgaccgggggucgggcgggaucaagggcggguuugugcaccagcgcauggccuccaagaucggccggugguacagccgcaccauguccaagaccgagcggaugggcauggggcuguacgucaaguacgacggcgaucccugggccgacagcgacgcgcuggccuucuccggggugauggugagcaugaaggagccgggcugguacuccuuuggguucgagaucaaggacaagaagugcgacguccccugcaucggcaucgagauggugcacgauggcgggaaggagaccuggcacagcgccgccacggccaucuacugccucaugggcuccgggcagcugcugugggacaccgugaccggcgucgacauggcgcucuga

SEQ ID NO: 28864 - RNA, 1401 nt, Artificial Sequence
  derived and/or modified CDS sequence (AUadapt) from InfluenzaB__ACF54151__NA
augcugcccaguaccauccagacccucacgcuguuccugaccuccggcggggugcuccugagccuguacgucuccgccucgcucuccuaccugcuguacagcgauauccuccugaaguucccguccaccgagaucaccgcccccacgaugccccuggacugcgcgaacgccagcaacgugcaggccgugaaccgcuccgccaccaagggcgucacccuccugcugcccgagccggaguggaccuauccccggcucucgugccccggguccacguuccagaaggcccugcugaucagcccccaccgcuucggcgagaccaaggggaacuccgcgccgcucaucauccgggagcccuuuaucgccugcggccccaaggagugcaagcacuucgcccugacccacuacgccgcgcagcccggcggguacuauaacggcacccgcgggaaccggaacaagcugcgccaccucaucagcgugaagcugggcaagaucccgacgguggagaacuccaucuuccacauggccgccuggaguggguccgccugccacgacggcaaggaguggaccuacaucggcgucgacgggcccgacaacaaugcccugcucaagaucaaguacggcgaggcguacaccgacaccuaccacagcuacgccaauaacauccugcggacgcaggaguccgccugcaacugcaucgggggcaacugcuaccugaugaucaccgauggcucggccagcgggguguccgagugccgcuuccucaagauccgggagggccgcaucaucaaggagaucuuccccaccgggcggaucaagcacaccgaggagugcacguguggcuucgccagcaacaagaccaucgagugcgcgugccgcgacaacuccuacaccgccaagcggcccuuugugaagcugaacgucgagaccgacacggccgagauccgccugaugugcaccgagaccuaccucgacaccccgcggcccgacgacgggaguaucacgggccccugcgaguccaacggcgacaaggggagcggcgggaucaagggcggguucgugcaccagcgcauggccuccaagaucggccggugguacagucgcaccauguccaagaccaagcggaugggcauggggcuguacgugaaguacgacggcgaccccugggccgacucggacgcgcuggccuuuuccggggucauggugagcauggaggagccgggcugguacuccuucggguucgagaucaaggacaagaagugcgacgugcccuguaucggcaucgagaugguccacgacggcgggaaggagaccuggcacagcgccgccacggccaucuacugccucaugggcuccgggcagcugcugugggacaccgugaccggcgugaacauggcgcucuga

SEQ ID NO: 28865 - RNA, 1401 nt, Artificial Sequence
  derived and/or modified CDS sequence (AUadapt) from InfluenzaB__ACF54162__NA
augcugcccaguaccauccagacccucacgcuguuccugaccuccggcggggugcuccugagccuguacgucuccgccucgcucuccuaccugcuguacagcgauauccuccugaaguucucccagaccgagaucaccgccccgaucaugccccuggacugcgcgaacgccucgaacgugcaggccgugaaccgcuccgccacgaagggcgucacccuccugcugcccgagcccgaguggaccuauccgcggcucagcugccccggguccaccuuccagaaggcccugcugaucagcccccaccgcuucggcgagacgaaggggaacuccgcgccccucaucauccgggagccguuuaucgccugcggccccaaggagugcaagcacuucgcccugacccacuacgccgcgcagcccggcggguacuauaacggcacccgcgaggaccggaacaagcugcgccaccucaucucggugaagcuggggaagauccccaccguggagaacuccaucuuccauauggccgccuggagcggcuccgccugccacgacgggaaggaguggacguacaucggcgucgacggcccggacaguaacgcccugcucaagaucaaguacggggaggcguacaccgacaccuaccacuccuacgccaagaauauccugcggacccaggagagcgccugcaacugcaucggcggggacugcuaccugaugaucacggauggccccgccucgggcaucuccgagugccgcuuccucaagauccgggaggggcgcaucaucaaggagaucuuccccaccggccgggugaagcacaccgaggagugcacgugcggguuugccagcaacaagaccaucgagugcgcgugccgcgacaacaacuauaccgccaagcggcccuucgugaagcugaacgucgagaccgacaccgccgagauccgccugaugugcacggagaccuaccucgacaccccgcggcccaacgauggcuccaucaccgggcccugcgagagcgacggcgacaagggcuccgggggcaucaagggcggguucgugcaccagcgcauggccucgaagaucgggcggugguauucccgcacgaugagcaagaccaagcggaugggcauggagcuguacgugaaguacgacggcgaccccuggaccgacuccgaggcccuggcgcucucgggggucaugguguccauggaggagccgggcugguauagcuucggguucgagaucaaggacaagaagugcgacgugcccugcaucggcaucgagaugguccaugacgggggcaagaccacguggcacuccgccgccaccgccaucuacugccugaugggcagcgggcagcugcucugggacaccgugaccggcguggacauggcccuguga

SEQ ID NO: 28866 - RNA, 1401 nt, Artificial Sequence
  derived and/or modified CDS sequence (AUadapt) from InfluenzaB__ACF54184__NA
augcugcccaguaccauccagacccucacgcuguuccugaccuccggcggggugcuccugagccuguacgucuccgccucgcucuccuaccugcuguacagcgacauccuccugaaguuuuccaccaccgagaucacggccccgaccaugccccuggacugcgcgaacgccucgaacgugcaggccgugaaccgcuccgccaccaagggcgucacccuccugcugcccgagcccgaguggacguacccgcggcucagcugucccggguccaccuuccagaaggcccugcugaucucgccccaccgcuucggcgagaccaaggggaacuccgcgccccucaucauccgggagccguucaucgccugcggccccaaggagugcaagcacuuugcccugacccacuacgccgcgcagcccggcggguacuacaacggcacgaaggaggaccgcaacaagcugcggcaccucaucagugugaagcuggggaagauccccaccguggagaacuccaucuuccacauggccgccuggucgggcuccgccugccacgacgggaaggaguggaccuacaucggcgucgauggcccggacagcaacgcccugcucaagaucaaguacggggaggcguacaccgacacguaccacuccuacgccaauaacauccugcgcacccaggagucggccugcaacugcaucggcgggaacugcuaccugaugaucaccgauggcagcgccuccggcaucucggagugccgguuccucaagauccgcgaggggcggaucaucaaggagaucuuccccaccggccgcgugaagcacacggaggagugcacgugcggguucgccuccaauaagaccaucgagugcgcgugccgggacaacagcuacaccgccaagcgccccuucgugaagcugaacgucgagaccgauaccgccgagauccggcugaugugcaccgagaccuaccucgacacgccccgcccggacgacggcuccaucaccgggcccugcgagucgaacggcaauaagggcuccgggggcaucaagggcggguucgugcaccagcggauggccagcaagaucgggcgcugguacucccggaccaugucgaagaccaagcgcaugggcaugggccuguacgugaaguacgacggggaccccuggacggauuccgacgcccuggcgcucagcggcgucaugguguccauggaggagcccgggugguacucguucggcuucgagaucaaggacaagaagugcgaugugccgugcaucgggaucgagaugguccacgacggcggcaaggagaccuggcacuccgccgccaccgccaucuacugccugauggggagcggccagcugcucugggacaccgugacggggguggacauggcccuguga

SEQ ID NO: 28867 - RNA, 1401 nt, Artificial Sequence
  derived and/or modified CDS sequence (AUadapt) from InfluenzaB__ACF54206__NA
augcugcccaguaccauccagacccucacgcuguuccugaccuccggcggggugcuccugagccuguacgucuccgccucgcucuccuaccugcuguacagugacauccuccugaaguucuccaccaccgagacgaccgccccgaccaugccccuggacugcgcgaacgccagcaacgugcaggccgugaaucgcuccgccaccaagggcgucacgcuccugcugcccgagcccgaguggaccuacccgcggcucucgugccccggguccaccuuccagaaggcccugcugaucagcccccaccgcuuuggcgagaccaaggggaacuccgcgccccucaucauccgggagccguucaucgccugcggccccaaggagugcaagcacuucgcccugacgcacuaugccgcgcagcccggcggguacuacaacggcacccgcgaggaccggaacaagcugcgccaccucaucucggugaagcuggggaagauccccaccguggagaauuccaucuuccacauggccgccuggagcggcuccgccugccacgacgggaaggaguggaccuauaucggcgucgacggcccggacagcaacgcccugcucaagaucaaguacggggaggcguacacggacaccuaucacuccuacgccaacaacauccugcggacccaggagucggccugcaacuguaucggcgggaacugcuaccugaugaucaccgacggcagcgccuccggcaucucggagugucgcuuccucaagauccgggaggggcgcaucaucaaggagaucuuccccacgggccgggugaagcacaccgaggagugcacgugcggguucgccuccaacaagaccaucgagugugcgugccgcgacaacagcuacaccgccaagcggcccuucgugaagcugaaugucgagaccgacaccgccgagauccgccugaugugcaccgagacguaccucgacacgccccggccggacgacggcuccaucaccgggcccugcgagaguaacggcaacaagggcuccgggggcaucaagggcggguucgugcaccagcgcauggccucgaagaucgggcggugguacucccgcaccaugagcaagaccaagcggaugggcaugggccuguaugugaaguacgacggggaccccuggaccgacuccgacgcccuggcgcucucgggcgucaugguguccauggaggagcccgggugguauagcuucggcuucgagaucaaggacaagaagugcgacgugccgugcaucgggaucgagaugguccaugacggcggcaaggagaccuggcacuccgccgccaccgccaucuacugccugauggggagcggccagcugcucugggacacggugaccgggguggacauggcccuguga

SEQ ID NO: 28868 - RNA, 1401 nt, Artificial Sequence
  derived and/or modified CDS sequence (AUadapt) from InfluenzaB__ACF54217__NA
augcugcccaguaccauccagacccucacgcuguuccugaccuccggcggggugcuccugagccuguacgucuccgccagccucuccuaccugcuguacagugacauccuccugaaguucucccagaccgagaucaccgccccgaucaugccccuggacugcgcgaacgccagcaaugugcaggccgugaaccacuccgccacgaagggcgucacccuccugcugcccgagcccgaguggaccuacccgcgccucagcugccccggguccaccuuccagaaggcccugcugaucaguccccaccgguucggcgagacgaaggggaacuccgcgccccucaucauccgcgagccguucaucgccugcggccccaaggagugcaagcauuucgcccugacccacuacgccgcgcagcccggcggguacuacaacggcacccgggaggaucgcaacaagcugcggcaccucaucucggugaagcuggggaagauccccaccguggagaacuccaucuuccacauggccgccuggaguggcuccgccugccacgacgggcgcgaguggacguacaucggcgucgacggcccggacaguaacgcccugcucaagaucaaguacggggaggcguacaccgacaccuaccacuccuaugccaagaacauccugcggacccaggagagcgccugcaacugcaucggcggggacuguuaccugaugaucacggacggccccgccucgggcaucuccgagugccgcuuccucaagauccgggaggggcgcaucaucaaggagaucuuccccaccggccgggugaagcauaccgaggagugcacgugcggguucgccagcaacaagaccaucgagugcgcgugucgcgacaacuccuacaccgccaagcggcccuucgugaagcugaacgucgagaccgacaccgccgagauccgccugauguguacggagaccuaccucgacaccccgcggcccaacgacggcagcaucaccgggcccugcgaguccaauggcgacaagggcagcgggggcaucaagggcggguucgugcaccagcgcauggccuccaagaucgggcggugguacucgcgcacgauguccaagaccaagcggaugggcaugggccuguaugugaaguacgacggggaccccuggaccgacagcgaggcccuggcgcucuccggcgucauggugagcauggaggagccggggugguauuccuucggcuucgagaucaaggacaagaagugcgacgugcccugcaucgggaucgagaugguccaugacggcggcaagaccacguggcacagcgccgccaccgccaucuacugccugaugggguccggccagcugcucugggacaccgugaccgggguggacauggcccuguga

SEQ ID NO: 28869 - RNA, 1401 nt, Artificial Sequence; identical to SEQ ID NO: 28760
  derived and/or modified CDS sequence (AUadapt) from InfluenzaB__ACF54228__NA

SEQ ID NO: 28870 - RNA, 1401 nt, Artificial Sequence; identical to SEQ ID NO: 28781
  derived and/or modified CDS sequence (AUadapt) from InfluenzaB__ACF54239__NA

SEQ ID NO: 28871 - RNA, 1401 nt, Artificial Sequence
  derived and/or modified CDS sequence (AUadapt) from InfluenzaB__ACF54261__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaaggagugcaagcauuucgcccugacccacuacgccgcgcagcccggcggguacuacaauggcacccgcgaggaccggaacaagcugcgccaccucgugagcgugaagcuggggaagaucccgacggucgagaacuccaucuuccauauggccgccuggucgggcuccgccugccacgacgggaaggaguggaccuacaucggcguggacggccccgauagcaacgcccugcucaagaucaaguacggggaggcguacaccgacaccuaccauuccuacgccaacaacauccugcggacgcaggagagcgccugcaacuguaucggcgggaacugcuaccugaugaucaccgacggcagcgccuccggcaucagugagugccgcuuccucaagauccgggaggggcgcaucaucaaggagaucuuccccaccggccgggugaagcacaccgaggagugcacgugcggguuugccuccaacaagaccaucgagugcgcgugccgcgacaacagcuauaccgccaagcggcccuucgucaagcugaacguggagaccgacacggccgagauccgccugaugugcaccgagaccuaccucgacaccccgcggcccgaugacggcuccaucacggggcccugcgagagcaacggcgacaagggcuccgggggcaucaagggcggguuugugcaccagcgcauggccagcaagaucgggcggugguacucccgcaccaugucgaagaccaagcggaugggcaugggccuguacgucaaguacgauggggaccccuggaccgacuccgacgcccuggcgcucagcggcgugaugguguccauggaggagccggggugguacagcuuuggcuucgagaucaaggacaagaagugcgacguccccugcaucgggaucgagauggugcacgauggcggcaaggagacguggcacuccgccgccaccgccaucuacugccugauggggagcggccagcugcucugggacaccgugaccggggucgacauggcccuguga

SEQ ID NO: 28872 - RNA, 1401 nt, Artificial Sequence
  derived and/or modified CDS sequence (AUadapt) from InfluenzaB__ACF54272__NA
augcugcccaguaccauccagacccucacgcuguuccugaccuccggcggggugcuccugagccuguacgucuccgccucgcucuccuaccugcuguacagugacauccuccugaaguucuccaccaccgagaucacggccccgaccaugccccuggacugcgcgaacgccagcaacgugcaggccgugaaucgcuccgccaccaagggcgucacccuccugcugcccgagcccgaguggacguacccgcggcucucgugccccggguccaccuuccagaaggcccugcugaucagcccccaccgcuuuggcgagaccaaggggaacuccgcgccccucaucauccgggagccguucaucgccugcggccccaaggagugcaagcacuucgcccugacccacuaugccgcgcagcccggcggguacuacaacggcacgcgcgaggaccggaacaagcugcgccaccucaucagcgugaagcuggggaagauccccaccguggagaauuccaucuuccacauggccgccuggucgggcuccgccugccacgacgggaaggaguggaccuauaucggcgucgacggcccggacagcaacgcccugcucaagaucaaguacggggaggcguacaccgacacguaucacuccuacgccaacaacauccugcggacccaggagagcgccugcaacuguaucggcgggaacugcuaccugaugaucaccgacggcucggccuccggcaucagcgagugucgcuuccucaagauccgggaggggcgcaucaucaaggagaucuuccccaccggccgggugaagcacacggaggagugcacgugcggguucgccuccaacaagaccaucgagugugcgugccgcgacaacagcuacaccgccaagcggcccuucgugaagcugaaugucgagaccgacaccgccgagauccgccugaugugcaccgagaccuaccucgacacgccccggccggacgacggcuccaucaccgggcccugcgagaguaacggcgacaagggcuccgggggcaucaagggcggguucgugcaccagcgcauggccagcaagaucgggcggugguacucccgcaccaugagcaagaccaagcggaugggcaugggccuguaugugaaguacgacggggaccccuggacggacuccgacgcccuggcgcucucgggcgucaugguguccauggaggagcccgggugguauagcuucggcuucgagaucaaggacaagaagugcgacgugccgugcaucgggaucgagaugguccaugacggcggcaaggagaccuggcacuccgccgccaccgccaucuacugccugauggggagcggccagcugcucugggacaccgugacggggguggacauggcccuguga

SEQ ID NO: 28873 - RNA, 1401 nt, Artificial Sequence
  derived and/or modified CDS sequence (AUadapt) from InfluenzaB__ACF54283__NA
augcugcccaguaccauccagacccucacgcuguuccugaccuccggcggggugcuccugagccuguacgucuccgccagccucuccuaccugcuguacagugacauccuccugaaguucuccaccaccgagaucacggccccgaccaugccccuggacugcgcgaacgccagcaaugugcaggccgugaaccgcuccgccaccaagggcgucacccuccugcugcccgagcccgaguggacguacccgcggcucagcugccccggguccaccuuccagaaggcccugcugaucucgccccaucgcuucggcgagaccaaggggaacuccgcgccccucaucauccgggagccguucaucgccugcggccccaaggagugcaagcacuuugcccugacccacuacgccgcgcagcccggcggguacuacaacggcacgcgcgaggaccggaauaagcugcgccaccucgugagcgugaagcuggggaagauccccaccgucgagaacuccaucuuccacauggccgccuggagcggcuccgccugccaugacgggaaggaguggaccuacaucggcguggacggcccggacagcaacgcccugcucaagaucaaguauggggaggcguacaccgacacguaccacuccuacgccaacaauauccugcggacccaggagucggccugcaacugcaucggcgggaacugcuaucugaugaucaccgacggcagcgccuccggcaucagcgagugccgcuuccucaagauccgggaggggcgcaucaucaaggagaucuuccccaccggccgggugaagcauacggaggagugcacgugcggguucgccuccaacaagaccaucgagugcgcgugccgcgauaacucguacaccgccaagcggcccuucgucaagcugaacguggagaccgacaccgccgagauccgccugaugugcaccgagaccuaucucgacacgccccggccggacgacggcuccaucaccgggcccugcgagagcaacggcgauaagggcuccgggggcaucaagggcggguucgugcaccagcgcauggccagcaagaucgggcggugguacucccgcaccaugucgaagaccaagcggaugggcaugggccuguacgucaaguaugacggggaccccuggacggacuccgacgcccuggcgcucagcggcgugaugguguccauggaggagcccgggugguacaguuucggcuucgagaucaaggacaagaagugcgacgucccgugcaucgggaucgagauggugcaugacggcggcaaggagaccuggcacuccgccgccaccgccaucuacugccugauggggagcggccagcugcucugggacaccgugacgggggucgacauggcccuguga

SEQ ID NO: 28874 - RNA, 1401 nt, Artificial Sequence
  derived and/or modified CDS sequence (AUadapt) from InfluenzaB__ACF54294__NA
augcugcccaguaccauccagacccucacgcuguuccugaccuccggcggggugcuccugagccuguacgucuccgccucgcucuccuaccugcuguacagcgauauccuccugaaguucuccaccaccgagaucacggccccgaccaucccccuggacugcgcgaacgccagcaacgugcaggccgugaaccgcuccgccaccaagggcgucaccuuccuccugcccgagcccgaguggacguauccgcggcugucgugccccggguccaccuuccagaaggcccuccugaucagcccccaccgcuucggcgagaccaaggggaacuccgcgccccugaucauccgggagccguucaucgccuguggccccaaggagugcaagcacuucgcccucacccacuacgccgcgcagcccggcggguacuacaacggcacgcgcgaggaucggaacaagcugcgccaccugaucucggugaagcucgggaagauccccaccguggagaacuccaucuuccacauggccgccuggagcggcuccgccugucacgacgggaaggaguggaccuacaucggcgucgacggcccggacagcaacgcccugcugaagaucaaguacggggaggcguauaccgacacguaccacuccuacgccaacaacauccuccggacccaggagucggccugcaauugcaucggcgggaacugcuaccugaugaucaccgacggcagcgccuccggcaucucggagugccgcuuucugaagauccgggaggggcgcaucaucaaggagaucuuccccaccggccgggugaagcacacggaggagugcacgugcggguucgccuccaacaagaccaucgagugcgcgugccgcgauaacagcuacaccgccaagcggcccuucgugaagcucaacgucgagaccgacaccgccgagauccgccugaugugcaccgagaccuaucuggacacgccccggccggacgacggcuccaucaccgggcccugcgagagcaacggcaacaagggcuccgggggcaucaagggcggguucgugcaucagcgcauggccucgaagaucgggcggugguacucccgcaccaugagcaagaccaagcggaugggcaugggccucuacgugaaguacgacggggaccccuggacggacuccgaugcccuggcgcugucgggcgucaugguguccauggaggagcccgggugguacagcuucggcuucgagaucaaggacaagaagugcgacgugccguguaucgggaucgagaugguccacgacggcggcaaggagaccuggcacuccgccgccaccgccaucuacugccucauggggagcggccagcugcugugggacaccgugacggggguggacauggcccucuga

SEQ ID NO: 28875 - RNA, 1401 nt, Artificial Sequence
  derived and/or modified CDS sequence (AUadapt) from InfluenzaB__ACF54305__NA
augcugcccaguaccauccagacccucacgcuguuccugaccuccggcggggugcuccugagccuguacgucuccgccucgcucuccuaccugcuguacagcgauauccuccugaaguucuccaccaccgagaucacggccccgaccaugccccuggacugcgcgaacgccagcaacgugcaggccgugaaccgcuccgccaccaagggcgucaccuuucuccugcccgagcccgaguggacguacccgcggcugucgugccccggguccaccuuccagaaggcccuccugaucagcccccaccgcuucggcgagaccaaggggaauuccgcgccccugaucauccgggagccguucaucgccugcggccccaaggagugcaagcacuucgcccucacccacuacgccgcgcagcccggcggguauuacaacggcacgcgcgaggaccggaacaagcugcgccaccugaucagcguggagcucgggaagauccccaccguggagaacuccaucuuccauauggccgccuggucgggcuccgccugccacgacgggaaggaguggaccuacaucggcgucgacggcccggacaguaacgcccugcugaagaucaaguacggggaggcguacaccgacacguaccacuccuacgccaauaacauccuccggacccaggagagcgccugcaacugcaucggcgggaacugcuaucugaugaucaccgacggcucggccuccggcaucagcgagugccgcuuccugaagauccgggaggggcgcaucaucaaggagaucuuccccaccggccgggugaagcacacggaggaguguacgugcggguucgccuccaacaagaccaucgagugcgcgugccgcgacaacagcuauaccgccaagcggcccuucgugaagcucaacgucgagaccgacaccgccgagauccgccugaugugcaccgagaccuaccuggacacgccccggccggacgauggcuccaucaccgggcccugcgagucgaacggcaacaagggcuccgggggcaucaagggcggguucgugcaccagcgcauggccagcaagaucgggcggugguauucccgcaccaugagcaagaccaagcggaugggcaugggccucuacgugaaguacgacggggaccccuggacggacuccgacgcccuggcgcugaguggcgucaugguguccauggaggagcccgggugguacagcuucggcuucgagaucaaggacaagaagugcgacgugccguguaucgggaucgagaugguccacgacggcggcaaggagaccuggcacuccgccgccaccgccaucuacugccucauggggagcggccagcugcugugggacaccgugacggggguggacauggcccucuga

SEQ ID NO: 28876 - RNA, 1401 nt, Artificial Sequence
  derived and/or modified CDS sequence (AUadapt) from InfluenzaB__ACF54316__NA
augcugcccaguaccauccagacccucacgcuguuccugaccuccggcggggugcuccugagccuguacgucuccgccagccucuccuaccugcuguauucggacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaacgaguguaagcacuucgcccugacccacuacgccgcgcagcccggcggguacuacaauggcacccgcggggaccggaacaagcugcgccaccucaucucggugaagcugggcaagaucccgacgguggagaacuccaucuuccauauggccgccuggagcggguccgccugccacgacggcaaggaguggaccuacaucggcgucgacgggcccgauaacaacgcccugcucaagaucaaguacggcgaggcguacaccgacaccuaccauagcuacgccaacaacauccugcggacgcaggaguccgccugcaacuguaucgggggcaacugcuaccugaugaucaccgacggcagcgccagugggguguccgagugccgcuuccucaagauccgggagggccgcaucaucaaggagaucuuccccaccgggcgggugaagcacaccgaggagugcacgugcggcuuugccagcaacaagaccaucgagugcgcgugccgcgacaacuccuauaccgccaagcggcccuucgucaagcugaacguggagaccgacacggccgagauccgccugaugugcaccgagaccuaccucgacaccccgcggcccgaugacgggagcaucacgggccccugcgaguccaacggcgacaaggggagcggcgggaucaagggcggguuugugcaccagcgcauggccuccaagaucggccggugguacucgcgcaccauguccaagaccgagcggaugggcauggggcuguacgucaaguacgacggcgaucccugggccgacagcgacgcgcuggcccucaucggggugaugguguccauggaggagccgggcugguacagcuucggguuugagaucaaggacaagaacugcgacguccccugcaucggcaucgagauggugcacgauggcgggaaggagaccuggcacuccgccgccacggccaucuacugccugaugggcagcgggcagcugcucugggacaccgugaccggcgucaacauggcgcuguga

SEQ ID NO: 28877 - RNA, 1404 nt, Artificial Sequence
  derived and/or modified CDS sequence (AUadapt) from InfluenzaB__ACF54338__NA
augcugcccaguaccauccagacccucacgcuguuccugaccuccggcggggugcuccugagccuguacgucuccgccagccucuccuaccugcuguacagugacauccuccugaaguucccguccaccgagaucaccgcccccacgaugccccuggacugcgcgaacgccagcaacgugcaggccgugaaucgcuccgccaccaagggcgucacccuccugcugcuccccgagccggaguggaccuacccccggcugagcugccccggguccacguuccagaaggcccugcucaucagcccccaccgcuuuggcgagaccaaggggaacuccgcgccgcugaucauccgggagcccuucaucgccugcggccccaaggagugcaagcacuucgcccugacccacuaugccgcgcagcccggcggguacuacaacggcacccgcggggaccggaacaagcuccgccaccugaucucggugaagcugggcaagaucccgacgguggagaauuccaucuuccacauggccgccuggagcggguccgccugccacgacggcaaggaguggaccuauaucggcgucgacgggcccgacaacaacgcccuccugaagaucaaguacggcgaggcguacaccgacaccuaucacagcuacgccaacaacauccugcggacgcaggaguccgccugcaacuguaucgggggcaacugcuaccucaugaucaccgacggcagcgccucggggguguccgagugucgcuuccugaagauccgggagggccgcaucaucaaggagaucuuccccaccgggcggaucaagcacaccgaggagugcacgugcggcuucgccagcaauaagaccaucgagugcgcgugccgcgacaacuccuacaccgccaagcggcccuucgugaagcugaaugucgagaccgacacggccgagauccgccucaugugcaccgagaccuaccuggacaccccgcggcccgacgacgggagcaucacgggccccugugaguccaacggcgggaagggcagcgggggcaucaagggcggguucgugcaccagcgcauggccuccaagaucggccggugguacucgcgcaccauguccaagaccgagcggaaggggaugggccuguacgugaaguaugacggggaccccugggccgacagcgacgcgcucgucuucuccggcgugauggugaguauggaggagccggggugguacuccuucggcuucgagaucaaggacaagaagugcgacguccccugcaucggcaucgagauggugcaugacgggggcaaggagaccuggcacagcgccgccacggccaucuacugccugaugggguccggccagcugcucugggacaccgugaccggcgucaacauggcccuguga

SEQ ID NO: 28878 - RNA, 1401 nt, Artificial Sequence
  derived and/or modified CDS sequence (AUadapt) from InfluenzaB__ACF54349__NA
augcugcccaguaccauccagacccucacgcuguuccugaccuccggcggggugcuccugagccuguacgucuccgccagccucuccuaccugcuguacagugacauccuccugaaguucucccagaccgagaucaccgccccgaucaugccccuggacugcgcgaacgccagcaaugugcaggccgugaaccgcuccgccgccaagggcgucacgcuccugcugcccgagcccgaguggaccuacccgcggcucagcugccccggguccaccuuccagaaggcgcugcugaucaacccccaucgcuucggcgagaccaaggggaacagcgcgccccucaucauccgggagccguucaucgccugcggccccacggagugcaagcauuucgcccugacccacuacgccgcccagcccggcggguacuacaacggcacccgcgaggaucggaacaagcugcgccaccucaucuccgugaagcuggggaagauccccaccguggagaacucgaucuuccacauggccgccugguccggcagugccugccacgacgggaaggaguggacguacaucggcgucgacggcccggacuccaaugcgcugcucaagaucaaguacggggaggccuacaccgacaccuaccacagcuaugccaagaacauccugcggacccaggaguccgccugcaacugcaucggcggggacugcuaucugaugaucacggacggcagcgccucgggcaucuccgagugccgcuuccucaagauccgggaggggcgcaucaucaaggagaucuuccccaccggccgggugaagcauaccgaggagugcacgugcggguucgcgagcaacaagaccaucgagugcgccugucgcgacaacuccuacaccgccaagcggcccuucgugaagcugaacgucgagaccgacaccgccgagauccgccugauguguacggagaccuaccucgacacgccccggccgaacgacggcagcaucaccgggcccugcgaguccgauggcgacaagggcagcgggggcaucaagggcggguucgugcaccagcgcauggccuccaagaucgggcggugguacucgcgcaccauguccaagaccaagcggaugggcaugggccuguaugugaaguacgacggggaccccuggaccgacagcgaggcgcuggcccucuccggcgucauggugagcauggaggagcccgggugguauuccuucggcuucgagaucaaggacaagaagugcgacgugccgugcaucgggaucgagaugguccaugacggcggcaagaccacguggcacagcgccgccaccgccaucuacugccugaugggguccggccagcugcucugggacaccgugaccgggguggacauggcgcuguga

SEQ ID NO: 28879 - RNA, 1401 nt, Artificial Sequence
  derived and/or modified CDS sequence (AUadapt) from InfluenzaB__ACF54371__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgaucaugccccuggacugugcgaacgccagcaacgugcaggccgugaaccgcuccgccgccaagggcgucacgcuccugcugcccgagcccgaguggaccuacccgcggcucaguugccccggguccaccuuccagaaggcgcugcugaucucgccccaccgcuucggcgagaccaaggggaauuccgcgccccucaucauccgggagccguucaucgccugcggccccacggagugcaagcacuucgcccugacccauuacgccgcccagcccggcggguacuacaacggcacccgcgaggaccggaauaagcugcgccaccucaucagcgugaagcuggggaagauccccaccguggagaacuccaucuuccacauggccgccuggaguggcuccgccugccacgacgggaaggaguggacguacaucggcgucgacggcccggauagcaacgcgcugcucaagaucaaguacggggaggccuacaccgacaccuaucacuccuacgccaagaacauccugcggacccaggagagcgccugcaauugcaucggcggggacugcuaccugaugaucacggacggccccgccaguggcaucuccgagugccgcuuccucaagauccgggaggggcgcaucaucaaggagaucuuccccaccggccgggugaagcacaccgaggagugcacguguggguucgcgucgaacaagaccaucgagugcgccugccgcgauaacuccuacaccgccaagcggcccuucgugaagcugaacgucgagaccgacaccgccgagauccgccugauguguacggagaccuaccucgacaccccgcggcccaacgacggcagcaucaccgggcccugugaguccgacggcgacaagggcagcgggggcaucaagggcggguucgugcaccagcgcauggccuccaagaucgggcggugguauagccgcacgauguccaagaccaagcggaugggcaugggccuguacgugaaguacgacggggaccccuggaccgauagcgaggcgcuggcccucuccggcgucauggugagcauggaggagccggggugguacuccuucggcuucgagaucaaggauaagaagugcgacgugcccugcaucgggaucgagaugguccacgacggcggcaagaccacguggcauagcgccgccaccgccaucuacugccugaccggguccggccagcugcucugggacaccgugacggggguggacauggcgcuguga

SEQ ID NO: 28880 - RNA, 1401 nt, Artificial Sequence
  derived and/or modified CDS sequence (AUadapt) from InfluenzaB__ACI22549__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccgcacgaugccccuggacugcgcgaacgccaguaacgugcaggccgugaaccgguccgccaccaagggcgucacccuccugcugcccgagcccgaguggaccuacccgcgccucagcugccccggguccacguuucagaaggcccugcugaucagcccccaccgguucggcgagaccaaggggaacuccgcgccccucaucauccgcgagccguucaucgccugcggccccaaugagugcaagcacuucgcccugacccacuacgccgcgcagcccggcggguauuacaacggcacccgcggggaccggaacaagcugcggcaccucaucagcgugaagcugggcaagauccccacgguggaggauuccaucuuccacauggccgccuggagcggguccgccugccacgauggcaaggaguggaccuacaucggcgucgacgggccggacaacaacgcccugcucaagaucaaguacggcgaggcguauaccgacaccuaccacucguacgccaauaacauccugcgcacgcaggaguccgccugcaacugcaucgggggcaacugcuaucugaugaucaccgacggcagcgccagcgggguguccgagugccgguuccucaagauccgcgagggccggaucaucaaggagaucuuucccaccgggcgcgugaagcacaccgaggagugcacgugcggcuucgccagcaacaagaccaucgagugugcgugccgggacaacuccuacaccgccaagcgccccuucgucaagcugaauguggagaccgacacggccgagauccggcugaugugcaccgagaccuaccucgacacgccccgcccggacgacgggaguaucaccggccccugcgaguccaacggcgacaaggggucgggcgggaucaagggcggguucgugcaucagcggauggccuccaagaucggccgcugguacagccggaccauguccaagaccgagcgcaugggcauggggcuguacgucaaguacgacggcgaccccugggccgauagcgacgcgcuggcccucaucggggugaugguguccauggaggagcccggcugguacagcuucggguuugagaucaaggacaagaacugcgacgucccgugcaucggcaucgagauggugcacgauggcgggaaggagaccuggcacuccgccgccacggccaucuacugccugaugggcagcgggcagcugcucugggacaccgugaccggcgucaacauggcgcuguga

SEQ ID NO: 28881 - RNA, 1401 nt, Artificial Sequence
  derived and/or modified CDS sequence (AUadapt) from InfluenzaB__ACI22551__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccugacgaugccccucgacugcgcgaacgccagcaaugugcaggccgugaaccgcuccgccaccaagggcgucacccugcugcuccccgagcccgaguggaccuacccgcggcugagcugccccggguccacguuccagaaggcccugcucaucagcccccaucgcuucggcgagaccaaggggaacuccgcgccccugaucauccgggagccguucaucgccugcggccccaacgagugcaagcacuuugcccugacccacuacgccgcgcagcccggcggguacuacaacggcacccgcggggaccggaauaagcuccgccaccugaucucggugaagcugggcaagauccccacgguggagaacuccaucuuccacauggccgccuggagcggguccgccugucacgacggcaaggaguggaccuacaucggcgucgacgggccggacaacaacgcccuccugaagaucaaguauggcgaggcguacaccgacaccuaccacagcuacgccaauaacauccugcggacgcaggaguccgccugcaacugcaucgggggcaacugcuaucucaugaucaccgacggcagcgccucggggguguccgagugccgcuuccugaagauccgggagggccgcaucaucaaggagaucuuccccaccgggcgggugaagcauaccgaggagugcacgugcggcuucgccagcaacaagaccaucgagugcgcgugccgcgauaacuccuacaccgccaagcggcccuucgucaagcugaacguggagaccgacacggccgagauccgccucaugugcaccgagaccuaucuggacacgccccggccggacgacgggagcaucaccggccccugcgaguccaacggcgauaaggggagcggcgggaucaagggcggguucgugcaccagcgcauggccuccaagaucggccggugguacucgcgcaccauguccaagaccgagcggaugggcauggggcuguacgucaaguacgauggcgaccccugggccgacagcgacgcgcucgcccugaucggggugaugguguccauggaggagcccggcugguacagcuuuggguucgagaucaaggacaagaacugcgacgucccgugcaucggcaucgagauggugcaugacggcgggaaggagaccuggcacuccgccgccacggccaucuacugccugaugggcagcgggcagcuccugugggacaccgugaccggcgucaacauggcgcuguga

SEQ ID NO: 28882 - RNA, 1401 nt, Artificial Sequence; identical to SEQ ID NO: 28881
  derived and/or modified CDS sequence (AUadapt) from InfluenzaB__ACI22555__NA

SEQ ID NO: 28883 - RNA, 1401 nt, Artificial Sequence; identical to SEQ ID NO: 28748
  derived and/or modified CDS sequence (AUadapt) from InfluenzaB__ACI22557__NA

SEQ ID NO: 28884 - RNA, 1401 nt, Artificial Sequence
  derived and/or modified CDS sequence (AUadapt) from InfluenzaB__ACI22559__NA
augcugcccaguaccauccagacccucacgcuguuccugaccuccggcggggugcuccugagccuguacgucuccgccagccucuccuaccugcuguacagugacauccuccugaaguucccguccaccgagaucaccgcccccacgaugccccuggacugcgcgaacgccagcaaugugcaggccgugaaccucuccgccaccaagggcgucacccugcugcuccccgagccggaguggaccuacccccgccugagcugccccggguccacguuccagaaggcccugcucaucagcccccaucgguucggcgagaccaaggggaacuccgcgccgcugaucauccgcgagcccuucaucgccugcggccccaaggagugcaagcacuuugcccugacccacuacgccgcgcagcccggcggguacuacaacggcacccgcggggaccggaauaagcuccggcaccugaucucggugaagcugggcaagaucccgacgguggagaacuccaucuuccacauggccgccuggagcggguccgccugccaugacggcaaggaguggaccuacaucggcgucgacgggcccgacaacaacgcccuccugaagaucaaguauggcgaggcguacaccgacaccuaccacagcuacgccaauaacauccugcgcacgcaggaguccgccugcaacugcaucgggggcaacugcuaucucaugaucaccgacggcagcgccucggggguguccgagugccgguuccugaagauccgcgagggccggaucaucaaggagaucuuccccaccgggcgcaucaagcauaccgaggagugcacgugcggcuucgccagcaacaagaccaucgagugcgcgugucgggacaacuccuacaccgccaagcgccccuucgugaagcugaacgucgagaccgacacggccgagauccggcucaugugcaccgagaccuaucuggacaccccgcgccccgacgacgggagcaucacgggccccugcgaguccaacggcgggaagggcagugggggcaucaagggcggguucgugcaccagcggauggccuccaagaucggccgcugguacucgcggaccauguccaagaccgagcgcaaggggaugggccuguacgugaaguacgauggggaccccugggccgacagcgacgcgcucgccuucuccggcgucauggugagcauggaggagccggggugguauuccuucggcuucgagaucaaggacaagaagugcgacgugcccugcaucggcaucgagaugguccaugacgggggcaaggagaccuggcacagcgccgccacggccaucuacugccugaugggguccggccagcugcucugggacaccgugaccggcgugaacauggcgcuguga

SEQ ID NO: 28885 - RNA, 1401 nt, Artificial Sequence
  derived and/or modified CDS sequence (AUadapt) from InfluenzaB__ACI22561__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgggacccuccugcugcccgagccggaguggaccuacccccggcucagcugccccggcuccacguuucagaaggcccugcugaucagcccccaccgcuucggggagaccaagggcaacuccgcgccgcucaucauccgggagcccuucaucgccugcggccccaaugagugcaagcacuucgcccugacccacuacgccgcgcagcccgggggcuauuacaacgggacccgcggcgaccggaacaagcugcgccaccucaucagcgucaagcuggggaagaucccgacgguggagaauuccaucuuccacauggccgccuggagcggcuccgccugccacgauggcaaggaguggaccuacaucgggguggacggccccgacaacaacgcccugcucaagaucaaguacggggaggcguauaccgacaccuaccacucguacgccaauaagauccugcggacgcaggaguccgccugcaacugcaucggcggcaacugcuaccugaugaucaccgaugggagcgccagcggcgucuccgagugccgcuuccucaagauccgggaggggcgcaucaucaaggagaucuuccccaccggccgggugaagcauaccgaggagugcacgugcggguucgccagcaacaagaccaucgagugcgcgugucgcgacaacuccuacaccgccaagcggcccuucgugaagcugaacgucgagaccgauacggccgagauccgccugaugugcaccgacaccuaccucgacaccccgcggcccgacgacggcaguaucacgggccccugcgaguccaacggggacaagggcucggggggcaucaagggcggguucgugcaucagcgcauggccuccaagaucggccggugguacagccgcaccauguccaagaccgagcggauggggaugggccuguacgugaaguacgacggggaccccugggccgauagcgacgcgcuggccuucuccggcgucauggugagcaugaaggagccggggugguacuccuuuggcuucgagaucaaggacaagaagugcgacgugcccugcaucggcaucgagaugguccacgaugggggcaaggagaccuggcacagcgccgccacggccaucuacugccucaugggguccggccagcugcugugggacaccgugaccggcguggacauggcgcucuga

SEQ ID NO: 28886 - RNA, 1401 nt, Artificial Sequence; identical to SEQ ID NO: 28748
  derived and/or modified CDS sequence (AUadapt) from InfluenzaB__ACI22563__NA

SEQ ID NO: 28887 - RNA, 1401 nt, Artificial Sequence
  derived and/or modified CDS sequence (AUadapt) from InfluenzaB__ACI22565__NA
augcugcccaguaccauccagacccucacgcuguuccugaccuccggcggggugcuccugagccuguacgucuccgccagccucuccuaccugcuguauagcgacauccuccugaaguucccguccaccgagaucaccgcccccacgaugccccuggacugcgcgaacgccaguaacgugcaggccgugaaccacuccgccaccaagggcgucacccuccugcugcccgagccggaguggaccuacccccgccucagcugccccggguccacguuucagaaggcccugcugaucagcccccaccgguucggcgagaccaaggggaacuccgcgccgcucaucauccgcgagcccuucaucgccugcggccccaaggaguguaagcacuucgcccugacccacuacgccgcgcagcccggcggguacuacaauggcacccgcggggaccggaacaagcugcggcaccucaucagcgugaagcugggcaagaucccgacgguggagaacuccaucuuccauauggccgccuggagcggguccgccugccacgacggcaaggaguggaccuacaucggcgucgaugggcccgacaacaacgcccugcucaagaucaaguacggcgaggcguacaccgacaccuaucacucguacgccaacaacauccugcgcacgcaggaguccgccugcaauugcaucgggggcaacugcuaccugaugaucaccgacggcagcgccagugggguguccgagugccgguuccucaagauccgcgagggccggaucaucaaggagaucuuccccaccgggcgcaucaagcacaccgaggagugcacgugcggcuuugccagcaacaagaccaucgagugcgcgugccgggacaacuccuauaccgccaagcgccccuucgugaagcugaacgucgagaccgacacggccgagauccggcugaugugcaccgagaccuaccucgauaccccgcgccccgacgacgggagcaucacgggccccugcgaguccaacggcgggaagggcucggggggcaucaagggcggguuugugcaccagcggauggccuccaagaucggccgcugguacagccggaccauguccaagaucgagcgcaaggggaugggccuguacgugaaguacgacggggaucccugggccgacagcgacgcgcuggccuucuccggcgucauggugagcauggaggagccggggugguacuccuuuggcuucgagauccgggacaagaagugcgacgugcccugcaucggcaucgagaugguccacgaugggggcaaggagaccuggcacagcgccgccaccgccaucuacugccucaugggguccggccagcugcugugggacacggugaccggcgugaacauggcgcucuga

SEQ ID NO: 28888 - RNA, 1401 nt, Artificial Sequence; identical to SEQ ID NO: 28748
  derived and/or modified CDS sequence (AUadapt) from InfluenzaB__ACI22567__NA

SEQ ID NO: 28889 - RNA, 1401 nt, Artificial Sequence; identical to SEQ ID NO: 28748
  derived and/or modified CDS sequence (AUadapt) from InfluenzaB__ACI22569__NA

SEQ ID NO: 28890 - RNA, 1401 nt, Artificial Sequence
  derived and/or modified CDS sequence (AUadapt) from InfluenzaB__ACJ53908__NA
augcugcauucgaccauccagacccucacgcuguuccugaccuccggcggggugcuccugagccuguacgucuccgccagccucuccuaucugcuguacagcgacauccuccugaaguucucccagaccgagaucaccgcccccaucaugccgcuggacugugcgaacgccagcuccgugcaggccgugaaccgcagcgccgccaagggcgucacgcuccugcugcccgagcccgaguggaccuacccccggcucuccuguccggggucgaccuuccagaaggcgcugcugaucagcccccaccgcuucggcgagaccaaggggaacuccgcgccccucaucauccgggagcccuuuaucgccugcggcccgacggagugcaagcacuucgcccugacccacuaugccgcccagcccggcggguacuacaacggcacccgcgaggaccggaacaagcugcgccaucucaucuccgugaagcuggggaagauccccaccguggagaacagcaucuuccacauggccgccugguccggcagcgccugccaugacgggaaggaguggacguacaucggcgucgacggccccgacuccaacgcgcugcucaagaucaaguauggggaggccuacaccgacaccuaccacagcuaugccaagaacauccugcggacccaggagagcgccugcaacugcaucggcggggacuguuaccugaugaucacggacggcccggccuccggcaucagcgagugccgcuuccucaagauccgggaggggcgcaucaucaaggagaucuuucccaccggccgggugaagcacaccgaggagugcacgugcggguucgcguccaacaagaccaucgagugugccugccgcgacaacucguacaccgccaagcggcccuucgugaagcugaaugucgagaccgacaccgccgagauccgccugaugugcacggagaccuaccucgacacgccccggccgaacgauggcuccaucaccgggcccugcgagagcgacggcgacaagggcuccgggggcaucaagggcggguucgugcaucagcgcauggccagcaagaucgggcggugguacucccgcaccaugagcaagaccaagcggaugggcaugggccuguacgugaaguacgacggggaucccuggaccgacuccgaggcgcuggcccucagcggcgucaugguguccauggaggagcccgggugguacagcuucggcuuugagaucaaggacaagaagugcgacgugccgugcaucgggaucgagaugguccacgauggcggcaagaccacguggcacuccgccgccaccgccaucuacugccugauggggagcggccagcugcucugggacaccgugaccgggguggacauggcgcuguga

SEQ ID NO: 28891 - RNA, 1401 nt, Artificial Sequence; identical to SEQ ID NO: 28766
  derived and/or modified CDS sequence (AUadapt) from InfluenzaB__ACN32560__NA

SEQ ID NO: 28892 - RNA, 1401 nt, Artificial Sequence; identical to SEQ ID NO: 28836
  derived and/or modified CDS sequence (AUadapt) from InfluenzaB__ACN32582__NA

SEQ ID NO: 28893 - RNA, 1401 nt, Artificial Sequence; identical to SEQ ID NO: 28748
  derived and/or modified CDS sequence (AUadapt) from InfluenzaB__ACN32593__NA

SEQ ID NO: 28894 - RNA, 1401 nt, Artificial Sequence
  derived and/or modified CDS sequence (AUadapt) from InfluenzaB__ACN32604__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccucgaaugugcacgccgugaaccgcuccgccaccaagggcgucacccuccugcugcccgagccggaguggaccuacccccggcucagcugccccggguccacguuccagaaggcccugcugaucagcccccaucgcuucggcgagaccaaggggaacuccgcgccgcucaucauccgggagcccuucaucgccugcggccccaacgagugcaagcauuucgcccugacccacuacgccgcgcagcccggcggguacuacaacggcacccgcggggaccggaauaagcugcgccaccucaucagcgugaagcugggcaagaucccgacgguggagaacuccaucuuccacauggccgccuggagcggguccgccugucacgacggcaaggaguggaccuacaucggcgucgacgggcccgacaacaacgcccugcucaagaucaaguauggcgaggcguacaccgacaccuaccacucguacgccaauaacauccugcggacgcaggaguccgccugcaacugcaucgggggcaacugcuaccugaugaucaccgauggcagcgccagcgggguguccgagugccgcuuccucaagauccgggagggccgcaucaucaaggagaucuuccccaccgggcgggugaagcacaccgaggaguguacgugcggcuucgccagcaacaagaccaucgagugcgcgugccgcgacaauuccuacaccgccaagcggcccuucgucaagcugaacguggagaccgacacggccgagauccgccugaugugcaccgacaccuaucucgacaccccgcggcccgacgacgggagcaucacgggccccugcgaguucaacggcgauaagggguccggcgggaucaagggcggguucgugcaccagcgcauggccucgaagaucggccggugguacucccgcaccaugagcaagaccgagcggaugggcauggggcuguacgucaaguaugacggcgaccccugggccgacuccgacgcgcuggccuucagcggggugaugguguccaugaaggagccgggcugguacaguuucggguucgagaucaaggacaagaagugcgacguccccugcaucggcaucgagauggugcaugacggcgggaaggagaccuggcacuccgccgccacggccaucuacugccucaugggcagcgggcagcugcugugggacaccgugaccggcgucgacauggcgcucuga

SEQ ID NO: 28895 - RNA, 1401 nt, Artificial Sequence; identical to SEQ ID NO: 28748
  derived and/or modified CDS sequence (AUadapt) from InfluenzaB__ACN32615__NA

SEQ ID NO: 28896 - RNA, 1401 nt, Artificial Sequence
  derived and/or modified CDS sequence (AUadapt) from InfluenzaB__ACN32775__NA
augcugcccaguaccauccagacccucacgcuguuccugaccuccggcggggugcuccugagccuguacgucuccgccagccucuccuaccugcuguacucggauauccuccugaaguucuccccgaccgagaucaacgcccccaccaugccccuggacugcgcgaacgccagcaacgugcaugccgugaaccgcuccgccacgaagggcgucacccuccugcugcccgagccggaguggaccuacccccggcucagcugccccggguccaccuuccagaaggcccugcugaucucgccccaccgcuuuggcgagacgaaggggaacuccgcgccgcucaucauccgggagcccuucaucgccugcggccccaacgagugcaagcacuucgcccugacccauuacgccgcgcagcccggcggguacuacaacggcacccgcggggaccggaacaagcugcgccaccucaucagugugaagcugggcaagaucccgaccguggagaacuccaucuuccacauggccgccuggagcggguccgccugccacgacggcaaggaguggacguauaucggcgucgacgggcccgacaacaacgcccugcucaagaucaaguacggcgaggcguacaccgacaccuaucacagcuacgccaacaacauccugcggacccaggaguccgccugcaacuguaucgggggcaacugcuaccugaugaucacggacggcucggccagcgggaucuccgagugccgcuuucucaagauccgggagggccgcaucaucaaggagaucuuccccaccgggcgggugaagcacaccgaggagugcacgugcggcuucgccagcaacaaguccaucgagugugcgugccgcgacaacucguacaccgccaagcggcccuucgugaagcugaacgucgagaccgauaccgccgagauccgccugaugugcaccgacacguaccucgacaccccgcggcccgacgacggguccaucaccggccccugcgagaguaacggcgacaagggguccggcgggaucaagggcggguucgugcaccagcgcauggccagcaagaucggccggugguacucccgcaccaugucgaagacggagcggaugggcauggggcuguaugugaaguacgacggcgaccccugggccgacuccgacgcgcuggccuucagcggggucaugguguccaugaaggagccgggcugguauagcuucggguucgagaucaaggacaagaagugcgacgugcccugcaucggcaucgagaugguccaugacggcgggaaggagaccuggcacuccgccgccaccgccaucuacugccucaugggcagcgggcagcugcugugggacaccgugacgggcguggacauggcgcucuga

SEQ ID NO: 28897 - RNA, 1401 nt, Artificial Sequence; identical to SEQ ID NO: 28748
  derived and/or modified CDS sequence (AUadapt) from InfluenzaB__ACN32786__NA

SEQ ID NO: 28898 - RNA, 1401 nt, Artificial Sequence
  derived and/or modified CDS sequence (AUadapt) from InfluenzaB__ACO05928__NA
augcugcccaguaccauccagacccucacgcuguuccugaccuccggcggggugcuccugagccuguacgucuccgccagccucuccuaccugcuguacagugacauccuccugaaguucccguccaccgagaucaccgcccccacgaugccccuggacugcgcgaacgccagcaaugugcaggccgugaaccgcuccgccaccaagggcgucacccuccugcugcccgagccggaguggaccuacccccggcucagcugccccggguccacguuccagaaggcccugcugaucucgccccaucgcuucggcgagaccaaggggaacuccgcgccgcucaucauccgggagcccuucaucgccugcggccccaaggagugcaagcacuuugcccugacccacuacgccgcgcagcccggcggguacuacaacggcacccgcggggaccggaacaagcugcgccaucucaucagcgugaagcugggcaagaucccgacgguggagaacuccaucuuccacauggccgccuggagcggguccgccugccaugacggcaaggaguggaccuacaucggcgucgacgggcccgacaacaacgcccugcucaagaucaaguauggcgaggcguacaccgacaccuaccacucguacgccaauaacauccugcggacgcaggaguccgccugcaacugcaucgggggcaacugcuaccugaugaucaccgauggcagcgccagcgggguguccgagugccgcuuccucaagauccgggagggccgcaucaucaaggagaucuuccccaccgggcggaucaagcacaccgaggaguguacgugcggcuucgccucgaacaagaccaucgagugcgcgugccgcgauaacuccuacaccgccaagcggcccuucgugaagcugaacgucgagaccgacacggccgagauccgccugaugugcaccgagaccuaucucgacaccccgcggcccgacgacgggagcaucacgggccccugcgaguccaacggcgacaaggggaguggcgggaucaagggcggguucgugcaccagcgcauggccuccaagaucggccggugguacucgcgcaccauguccaagaccaagcggaugggcauggggcuguacgugaaguacgauggcgaccccugggccgacagcgacgcgcuggccuucuccggggucauggugccgauggaggagcccggcugguacaguuucggguucgagaucaaggacaagaagugcgacgugcccugcaucggcaucgagaugguccaugacggcgggaaggagaccuggcacuccgccgccacggccaucuacugccucaugggcagcgggcagcugcugugggacaccgugaccggcgugaacauggcgcucuga

SEQ ID NO: 28899 - RNA, 1401 nt, Artificial Sequence; identical to SEQ ID NO: 28760
  derived and/or modified CDS sequence (AUadapt) from InfluenzaB__ACO05950__NA

SEQ ID NO: 28900 - RNA, 1401 nt, Artificial Sequence
  derived and/or modified CDS sequence (AUadapt) from InfluenzaB__ACO05961__NA
augcugcccaguaccauccagacccucacgcuguuccugaccuccggcggggugcuccugagccuguacgucuccgccagccucuccuaccugccguacagugacauccugcucaaguuccccuccaccgagaucaccgcccccacgaugccccuggacugcgcgaacgccagcaaugugcaggccgugaaccgcuccgccaccaagggcgucacccugcuccugccggagcccgaguggaccuacccccggcugagcugccccggguccacguuccagaaggcccuccugaucucgccgcaucgcuucggcgagaccaaggggaacuccgcgccccugaucauccgggagcccuucaucgccugcggccccaaggagugcaagcacuuugcccucacccacuacgccgcgcagccgggcggguacuacaacggcacccgcggggaccggaacaagcugcgccaucugaucagcgugaagcucggcaagauccccacgguggagaacuccaucuuccacauggccgccuggagcggguccgccugccaugacggcaaggaguggaccuacaucggcgucgacgggcccgacaacaacgcccugcugaagaucaaguauggcgaggcguacaccgacaccuaccacucguacgccaauaacauccuccggacgcaggaguccgccugcaacugcaucgggggcaacugcuaccugaugaucaccgauggcagcgccagcgggguguccgagugccgcuuccugaagauccgggagggccgcaucaucaaggagaucuuccccaccgggcggaucaagcacaccgaggaguguacgugcggcuucgccucgaacaagaccaucgagugcgcgugccgcgauaacuccuacaccgccaagcggccguucgugaagcucaacgucgagaccgacacggccgagauccgccugaugugcaccgagaccuaucuggacacgccccggcccgacgacgggagcaucaccggccccugcgaguccaacggcgacaaggggaguggcgggaucaagggcggguucgugcaccagcgcauggccuccaagaucggccggugguacucgcgcaccauguccaagaccaagcggaugggcauggggcucuacgugaaguacgauggcgacccgugggccgacagcgacgcgcuggccuucuccggggucauggugagcauggaggagcccggcugguauuccuucggguucgagaucaaggacaagaagugcgacgugcccugcaucggcaucgagaugguccaugacggcgggaaggagaccuggcacagcgccgccacggccaucuacugccugaugggcuccgggcagcuccugugggacaccgugaccggcgugaacauggcgcuguga

SEQ ID NO: 28901 - RNA, 1401 nt, Artificial Sequence
  derived and/or modified CDS sequence (AUadapt) from InfluenzaB__ACO05972__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaaugccagcaacgugcaggccgugaaccgcuccgccgccaagggcgucacgcuccugcugcccgagcccgaguggaccuacccgcggcucagcugucccggguccaccuuccagaaggcgcugcugaucucgccccaccgcuucggcgagaccaaggggaacuccgcgccccucaucauccgggagccguucaucgccuguggccccacggagugcaagcacuucgcccugacccacuacgccgcccagcccggcggguauuacaacggcacccgcgaggaccggaacaagcugcgccaccucaucagugugaagcuggggaagauccccaccguggagaacuccaucuuccacauggccgccuggagcggcuccgccugccaugacgggaaggaguggacguacaucggcgucgacggcccggacagcaacgcgcugcucaagaucaaguauggggaggccuacaccgacaccuaccacuccuacgccaagaauauccugcggacccaggagagcgccugcaacugcaucggcggggacuguuaccugaugaucacggacggccccgccagcggcaucuccgagugccgcuuccucaagauccgggaggggcgcaucaucaaggagaucuuucccaccggccgggugaagcacaccgaggagugcacgugcggguucgcgucgaacaagaccaucgagugugccugccgcgacaacuccuacaccgccaagcggcccuucgugaagcugaaugucgagaccgacaccgccgagauccgccugaugugcacggagaccuaccucgacaccccgcggcccaacgauggcagcaucaccgggcccugcgaguccgacggcgacaagggcagcgggggcaucaagggcggguuugugcaccagcgcauggccuccaagaucgggcggugguacagccgcacgauguccaagaccaagcggaugggcaugggccuguacgugaaguacgacggggaucccuggaccgacagcgaggcgcuggcccucuccggcgucauggugagcauggaggagccggggugguacuccuucggcuuugagaucaaggacaagaagugcgacgugcccugcaucgggaucgagaugguccacgauggcggcaagaccacguggcacagcgccgccaccgccaucuacugccugaugggguccggccagcugcucugggacaccgugaccgggguggacauggcgcuguga

SEQ ID NO: 28902 - RNA, 1401 nt, Artificial Sequence; identical to SEQ ID NO: 28901
  derived and/or modified CDS sequence (AUadapt) from InfluenzaB__ACO05983__NA

SEQ ID NO: 28903 - RNA, 1401 nt, Artificial Sequence; identical to SEQ ID NO: 28901
  derived and/or modified CDS sequence (AUadapt) from InfluenzaB__ACO05994__NA

SEQ ID NO: 28904 - RNA, 1401 nt, Artificial Sequence
  derived and/or modified CDS sequence (AUadapt) from InfluenzaB__ACO06005__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccagcaacgugcaggccgugaaccgcuccgccaccaagggcgucacccuccugcugcccgagccggaguggaccuacccccggcucagcugucccggguccacguuccagaaggcccugcugaucagcccccaccgcuucggcgagaccaaggggaacuccgcgccgcucaucauccgggagcccuuuaucgccugcggccccaacgagugcaagcacuucgcccugacccacuaugccgcgcagcccggcggguacuacaacggcacccgcggggaccggaacaagcugcgccaucucaucagcgugaagcugggcaagaucccgacgguggagaacuccaucuuccacauggccgccuggagcggguccgccugucacgacggcaaggaguggaccuacaucggcgucgacgggcccgacaauaacgcccugcucaagaucaaguacggcgaggcguacaccgacaccuaccauucguacgccaacaagauccugcggacgcaggaguccgccugcaacugcaucgggggcaauugcuaccugaugaucaccgacggcagcgccagcgggguguccgagugucgcuuccucaagauccgggagggccgcaucaucaaggagaucuuccccaccgggcgggugaagcacaccgaggagugcacgugcggcuuugccagcaacaagaccaucgagugcgcgugccgcgacaauuccuacaccgccaagcggcccuucgucaagcugaacguggagaccgacacggccgagauccgccugaugugcaccgauaccuaccucgacaccccgcggcccgacgacgggagcaucacgggccccugcgaguccaauggcgaccgcgggagcggcgggaucaagggcggguucgugcaccagcggauggccuccaagaucggccgcugguacagucggaccauguccaagaccgagcgcaugggcauggggcuguacgucaaguacgacggcgaccccugggccgacagugacgcgcuggccuucuccggggugauggugagcaugaaggagccgggcugguacuccuucggguuugagaucaaggacaagaagugcgacguccccugcaucggcaucgagauggugcacgauggcgggaaggagaccuggcacagcgccgccacggccaucuacugccucaugggcuccgggcagcugcugugggacaccgugaccggcgucgacauggcgcucuga

SEQ ID NO: 28905 - RNA, 1401 nt, Artificial Sequence
  derived and/or modified CDS sequence (AUadapt) from InfluenzaB__ACO06027__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaacgccaguaacgugcaggccgugaaccgcuccgccgccaagggcgucacgcuccugcugcccgagcccgaguggaccuacccgcggcucagcugccccggguccaccuuucagaaggcgcugcugaucagcccccaccgcuucggcgagaccaaggggaacuccgcgccccucaucauccgggagccguucaucgccugcggccccacggaguguaagcacuucgcccugacccacuacgccgcccagcccggcggguacuacaauggcacccgcgaggaccggaacaagcugcgccaccucaucagcgugaagcuggggaagauccccaccguggagaacuccaucuuucacauggccgccuggagcggcuccgccugccacgacgggaaggaguggacguacaucggcgucgauggcccggacucgaacgcgcugcucaagaucaaguacggggaggccuacaccgauaccuaccacuccuacgccaagaacauccugcggacccaggagagcgccugcaauugcaucggcggggacugcuaccugaugaucacggacggccccgccagcggcaucuccgagugucgcuuccucaagauccgggaggggcgcaucaucaaggagaucuuccccaccggccgggugaagcacaccgaggagugcacgugcggguuugcgagcaacaagaccaucgagugcgccugccgcgacaacuccuauaccgccaagcggcccuucgugaagcugaacgucgagaccgacaccgccgagauccgccugaugugcacggagaccuaccucgauaccccgcggcccaacgacggcagcaucaccgggcccugcgaguccgacggcgacaagggcagugggggcaucaagggcggguucgugcaccagcgcauggccuccaagaucgggcggugguacagccgcacgauguccaagaccaagcggaugggcaugggccuguacgugaaguacgauggggaccccuggaccgacagcgaggcgcuggcccucuccggcgucauggugagcauggaggagccggggugguacuccuuuggcuucgagaucaaggacaagaagugcgacgugcccugcaucgggaucgagaugguccacgauggcggcaagaccacguggcacagcgccgccaccgccaucuacugccugaugggguccggccagcugcucugggacaccgugaccgggguggacaugacgcuguga

SEQ ID NO: 28906 - RNA, 1401 nt, Artificial Sequence
  derived and/or modified CDS sequence (AUadapt) from InfluenzaB__ACO06066__NA
augcugcccaguaccauccagacccucacgcuguuccugaccuccggcggggugcuccugagccuguacgucuccgccagccucuccuaccugcuguacagugacauccuccugaaguucucccagaccgagaucaccgccccgaucaugccccuggacugcgcgaacgccucgaaugugcaggccgugaaccgcuccgucgccaagggcgugacgcuccugcugcccgagcccgaguggaccuacccgcggcucagcugccccggguccaccuuccagaaggcccugcugaucagcccccaucgcuucggcgagaccaaggggaacuccgcgccccucaucauccgggagccguucaucgccugcggccccacggagugcaagcacuuugcccugacccacuacgccgcgcagcccggcggguacuacaacggcacccgcgaggaccggaauaagcugcgccaccucaucagcgugaagcuggggaagauccccaccgucgagaacuccaucuuccacauggccgccuggagcggcuccgccugucacgacgggaaggaguggacguacaucggcguggacggcccggacucgaaugcccugcucaagaucaaguacggggaggcguacaccgacaccuaccacuccuacgccaagaauauccugcggacccaggagagcgccugcaacugcaucggcggggacugcuaucugaugaucacggacggccccgccagcggcaucuccgagugccgcuuccucaagauccgggaggggcgcaucaucaaggagaucuuccccaccggccgggugaagcacaccgaggaguguacgugcggguucgccagcaacaagaccaucgagugcgcgugccgcgauaacuccuacaccgccaagcggcccuucgucaagcugaacguggagaccgacaccgccgagauccgccugaugugcacggagaccuaucucgacaccccgcggcccaacgacggcagcaucaccgggcccugcgaguccgacggcgauaagggcucggggggcaucaagggcggguucgugcaccagcgcauggccuccaagaucgggcggugguacagccgcacgauguccaagaccaagcggaugggcaugggccuguacgucaaguaugacggggaccccuggaccgacagcgaggcccuggcgcucuccggcgugauggugagcauggaggagccggggugguacuccuuuggcuucgagaucaaggacaagaagugcgacguccccugcaucgggaucgagauggugcacgauggcggcaagaccacguggcacagcgccgccaccgccaucuacugccugaugggguccggccagcugcucugggacaccgugaccggggucgacaugacgcuguga

SEQ ID NO: 28907 - RNA, 1401 nt, Artificial Sequence
  derived and/or modified CDS sequence (AUadapt) from InfluenzaB__ACO94665__NA
augcugcccaguaccauccagacccucacgcuguuccugaccuccggcggggugcuccugagccuguacgucuccgccagccucuccuaccugcuguacagugacauccuccugaaguucuccccgaccgagaucaccgccucgacgaugccccuggacugcgcgaacgccuccaaugugcaggccgugaaccgcagcgccaccaagggcgucacccuccugcugcccgagcccgaguggaccuacccgcggcucuccugccccgggagcacguuccagaaggcccugcugaucagcccccaucgcuucggcgagaccaaggggaacuccgcgccccucaucauccgggagccguucaucgccugcggccccaacgagugcaagcauuucgcccugacccacuacgccgcgcagcccggcggguacuacaacggcacccgcggggaucggaacaagcugcgccaccucaucuccgugaagcugggcaagauccccacgguggagaacucgaucuuccacauggccgccugguccgggagcgccugucacgacggcaaggaguggaccuacaucggcgucgacgggccggacaacaaugcccugcucaagaucaaguacggcgaggcguacaccgacaccuaccacuccuacgccaauaagauccugcggacgcaggagagcgccugcaacugcaucgggggcaacugcuaccugaugaucaccgauggcagcgccuccggggugucggagugccgcuuccucaagauccgggagggccgcaucaucaaggagaucuuccccaccgggcgggugaagcacaccgaggaguguacgugcggcuucgccuccaacaagaccaucgagugcgcgugccgcgacaauagcuacaccgccaagcggcccuucgucaagcugaacguggagaccgacacggccgagauccgccugaugugcaccgacaccuaucucgacacgccccggccggacgacggguccaucaccggccccugcgagagcaacggcgauaagggguccggcgggaucaagggcggguucgugcaccagcgcauggccagcaagaucggccggugguacucccgcaccaugucgaagaccgagcggaugggcauggggcuguacgucaaguaugacggcgaccccugggccgacuccgacgcgcuggccuucagcggggugaugguguccaugaaggagcccggcugguacaguuucggguucgagaucaaggacaagaagugcgacgucccgugcaucggcaucgagauggugcaugacggcgggaaggagaccuggcacuccgccgccacggccaucuacugccucaugggcagcgggcagcugcugugggacaccgugaccggcgucgacauggcgcucuga

SEQ ID NO: 28908 - RNA, 1401 nt, Artificial Sequence; identical to SEQ ID NO: 28748
  derived and/or modified CDS sequence (AUadapt) from InfluenzaB__ACQ45607__NA

SEQ ID NO: 28909 - RNA, 1401 nt, Artificial Sequence
  derived and/or modified CDS sequence (AUadapt) from InfluenzaB__ACQ45610__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacggugccccuggacugcgcgaacgccaguaacgugcaggccgucaaccgcuccgccaccaagggcgugacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaacgaguguaagcacuucgcccugacccacuacgccgcgcagcccggcggguacuacaauggcacccgcggggaccggaacaagcugcgccaccucaucagcgugaagcugggcaagaucccgacggucgagaacuccaucuuccauauggccgccuggagcggguccgccugccacgacggcaaggaguggaccuacaucggcguggacgggcccgauaacaacgcccugcucaagaucaaguacggcgaggcguacaccgacaccuaccauagcuacgccaacaagauccugcggacgcaggaguccgccugcaacugcaucgggggcaauugcuaccugaugaucaccgacggcagcgccagcgggguguccgagugucgcuuccucaagauccgggagggccgcaucaucaaggagaucuuccccaccgggcgggucaaguacaccgaggagugcacgugcggcuucgccaguaacaagaccaucgagugcgcgugccgcgacaacuccuacaccgccaagcggcccuuugugaagcugaacguggagaccgacacggccgagauccgccugaugugcaccgacaccuaccucgacaccccgcggcccgaugacgggagcaucacgggccccugcgaguccaacggcgacaaggggagcggcgggaucaagggcggguuuguccaccagcgcauggccuccaagaucggccggugguacagccgcaccauguccaagaccgagcggaugggcauggggcuguacgugaaguacgacggcgaucccugggccgacagcgacgcgcuggccuucuccggggugauggucagcaugaaggagccgggcugguacuccuuuggguucgagaucaaggacaagaagugcgacgugcccugcaucggcaucgagauggugcacgauggcgggaaggagaccuggcacagcgccgccacggccaucuacugccucaugggcuccgggcagcugcugugggacaccgucaccggcguggacauggcgcucuga

SEQ ID NO: 28910 - RNA, 1401 nt, Artificial Sequence; identical to SEQ ID NO: 28748
  derived and/or modified CDS sequence (AUadapt) from InfluenzaB__ACQ45613__NA

SEQ ID NO: 28911 - RNA, 1401 nt, Artificial Sequence; identical to SEQ ID NO: 28904
  derived and/or modified CDS sequence (AUadapt) from InfluenzaB__ACR15626__NA

SEQ ID NO: 28912 - RNA, 1401 nt, Artificial Sequence; identical to SEQ ID NO: 28904
  derived and/or modified CDS sequence (AUadapt) from InfluenzaB__ACR15637__NA

SEQ ID NO: 28913 - RNA, 1401 nt, Artificial Sequence; identical to SEQ ID NO: 28875
  derived and/or modified CDS sequence (AUadapt) from InfluenzaB__ACR15648__NA

SEQ ID NO: 28914 - RNA, 1401 nt, Artificial Sequence; identical to SEQ ID NO: 28904
  derived and/or modified CDS sequence (AUadapt) from InfluenzaB__ACR15659__NA

SEQ ID NO: 28915 - RNA, 1401 nt, Artificial Sequence; identical to SEQ ID NO: 28904
  derived and/or modified CDS sequence (AUadapt) from InfluenzaB__ACR15670__NA

SEQ ID NO: 28916 - RNA, 1401 nt, Artificial Sequence; identical to SEQ ID NO: 28729
  derived and/or modified CDS sequence (AUadapt) from InfluenzaB__ACR15681__NA

SEQ ID NO: 28917 - RNA, 1401 nt, Artificial Sequence
  derived and/or modified CDS sequence (AUadapt) from InfluenzaB__ACR15692__NA
augcugcccaguaccauccagacccucacgcuguuccugaccuccggcggggugcuccugagccuguacgucuccgccagccucuccuaccugcuguauucggacauccuccugaaguucuccccgaccgagaucaccgcccccacgaugccccugggcugcgcgaacgccagcaaugugcaggccgugaaccgcuccgccaccaagggggucacccuccugcugcccgagccggaguggaccuacccccggcucagcugccccggcuccacguuccagaaggcccugcugaucucgccccaucgcuucggggagaccaagggcaacuccgcgccgcucaucauccgggagcccuucaucgccugcggccccaaggagugcaagcacuuugcccugacccacuacgccgcgcagcccgggggcuacuacaacgggacccgcggcgaucggaacaagcugcgccaccucaucagcgugaagcuggggaagaucccgacgguggagaacuccaucuuccacauggccgccuggaguggcuccgccugccacgacggcaaggaguggaccuacaucggggucgacggccccgacaauaacgcccugcucaagaucaaguacggggaggcguacaccgacaccuaccacaguuacgccaacaacauccugcggacgcaggaguccgccugcaacugcaucggcggcaauugcuaccugaugaucaccgacgggagcgccagcggcaucuccgagugucgcuuccucaagauccgggaggggcgcaucaucaaggagaucuuccccaccggccgggugaagcacaccgaggagugcacgugcggguucgccaguaacaagaccaucgagugcgcgugccgcgacaacuccuacaccgccaagcggcccuuugugaagcugaacgucgagaccgacacggccgagauccgccugaugugcaccgagaccuaccucgacaccccgcggcccgacgauggcagcaucacgggccccugcgaguccaacggggacaagggcagcgggggcaucaagggcggguuugugcaccagcgcauggccuccaagaucggccggugguacucgcgcaccauguccaagaccaagcggauggggaugggccuguacgugaaguacgacggggaucccugggccgacaacgacgcgcuggcccucagcggcgucaugguguccauggaggagccggggugguacagcuuuggcuucgagaucaaggacaagaagugcgacgugcccugcaucggcaucgagaugguccacgaugggggcaaggagaccuggcacuccgccgccacggccaucuacugccugauggggagcggccagcugcucugggacaccgugaccggcguggacauggcgcuguga

SEQ ID NO: 28918 - RNA, 1401 nt, Artificial Sequence; identical to SEQ ID NO: 28905
  derived and/or modified CDS sequence (AUadapt) from InfluenzaB__ACR15703__NA

SEQ ID NO: 28919 - RNA, 1401 nt, Artificial Sequence; identical to SEQ ID NO: 28905
  derived and/or modified CDS sequence (AUadapt) from InfluenzaB__ACR15714__NA

SEQ ID NO: 28920 - RNA, 1401 nt, Artificial Sequence; identical to SEQ ID NO: 28820
  derived and/or modified CDS sequence (AUadapt) from InfluenzaB__ACR15725__NA

SEQ ID NO: 28921 - RNA, 1401 nt, Artificial Sequence; identical to SEQ ID NO: 28781
  derived and/or modified CDS sequence (AUadapt) from InfluenzaB__ACR15736__NA

SEQ ID NO: 28922 - RNA, 1401 nt, Artificial Sequence; identical to SEQ ID NO: 28904
  derived and/or modified CDS sequence (AUadapt) from InfluenzaB__ACR39340__NA

SEQ ID NO: 28923 - RNA, 1401 nt, Artificial Sequence
  derived and/or modified CDS sequence (AUadapt) from InfluenzaB__ADL28399__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccagcaacgugcaggccgugaaccgcuccgccaccaagggcgucacccuccugcugcccgagccggaguggaccuacccccggcucagcugccccggguccacguuucagaaggcccugcugaucucgccccaccgcuucggcgagaccaaggggaacuccgcgccgcucaucauccgggagcccuucaucgccuguggccccaacgagugcaagcacuucgcccugacccacuacgccgcgcagcccggcggguauuacaacggcacccgcggggaccggaacaagcugcgccaccucaucagugugaagcugggcaagaucccgacgguggagaacuccaucuuccacauggccgccuggagcggguccgccugccacgauggcaaggaguggaccuacaucggcgucgacgggcccgacaacaacgcccugcucaagaucaaguauggcgaggcguacaccgacaccuaccacagcuacgccaauaacauccugcggacgcaggaguccgccugcaacugcaucgggggcaacuguuaccugaugaucaccgacggcagcgccagcgggguguccgagugccgcuuccucaagauccgggagggccgcaucaucaaggagaucuuucccaccgggcgggugaagcacaccgaggagugcacgugcggcuucgccagcaauaagaucaucgagugcgcgugccgcgacuccucguacaccgccaagcggcccuucgucaagcugaauguggagaccgacaccgccgagauccgccugaugugcacggagaccuaccucgacaccccgcggcccaacgauggguccaucaccggccccugcgagagcaacggcgacaagggguccggcgggaucaagggcggguucgugcaccagcgcauggccaguaagaucggccggugguacucccgcacgaugagcaagaccgagcggaugggcauggggcuguacgucaaguacgacggcgaucccugggccgacuccgacgcgcuggcccucagcggggugaugguguccauggaggagccgggcugguacagcuucggguuugagaucaaggacaagaagugcgacguccccugcaucggcaucgagauggugcacgauggcgggaaggagaccuggcacuccgccgccaccgccaucuacugccugaugggcagcgggcagcugcucugggacacggugaccggcgucgacauggcgcuguga

SEQ ID NO: 28924 - RNA, 1401 nt, Artificial Sequence; identical to SEQ ID NO: 28901
  derived and/or modified CDS sequence (AUadapt) from InfluenzaB__ADN32822__NA

SEQ ID NO: 28925 - RNA, 1401 nt, Artificial Sequence
  derived and/or modified CDS sequence (AUadapt) from InfluenzaB__ADR02756__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaucccccuggacugcgcgaaugccagcaacgugcaggccgugaaccgcuccgccgccaagggcgucacgcuccugcugcccgagcccgaguggaccuacccgcggcucagcugucccggguccaccuuccagaaggcgcugcugaucucgccccaccgcuucggcgagaccaaggggaacuccgcgccccucaucauccgggagccguucaucgccuguggccccacggagugcaagcacuucgcccugacccacuacgccgcccagcccggcggguauuacaacggcacccgcgaggaccggaacaagcugcgccaccucaucagugugaagcuggggaagauccccaccguggagaacuccaucuuccacauggccgccuggagcggcuccgccugccaugacgggaaggaguggacguacaucggcgucgacggcccggacagcaacgcgcugcucaagaucaaguauggggaggccuacaccgacaccuaccacuccuacgccaagaauauccugcggacccaggagagcgccugcaacugcaucggcggggacuguuaccugaugaucacggacggccccgccagcggcaucuccgagugccgcuuccucaagauccgggaggggcgcaucaucaaggagaucuuucccaccggccgggugaagcacaccgaggagugcacgugcggguucgcgucgaacaagaccaucgagugugccugccgcgacaacuccuacaccgccaagcggcccuucgugaagcugaaugucgagaccgacaccgccgagauccgccugaugugcacggagaccuaccucgacaccccgcggcccaacgauggcagcaucaccgggcccugcgaguccgacggcgacaagggcagcgggggcaucaagggcggguuugugcaccagcgcauggccuccaagaucgggcggugguacagccgcacgauguccaagaccaagcggaugggcaugggccuguacgugaaguacgacggggaucccuggaccgacagcgaggcgcuggcccucuccggcgucauggugagcauggaggagccggggugguacuccuucggcuuugagaucaaggacaagaagugcgacgugcccugcaucgggaucgagaugguccacgauggcggcaagaccacguggcacagcgccgccaccgccaucuacugccugaugggguccggccagcugcucugggacaccgugaccgggguggacauggcgcuguga

SEQ ID NO: 28926 - RNA, 1401 nt, Artificial Sequence
  derived and/or modified CDS sequence (AUadapt) from InfluenzaB__AEA51353__NA
augcugcccaguaccauccagacccucacgcuguuccugaccuccggcggggugcuccugagccuguacgucuccgccagccucuccuaccugcuguauagcgacauccuccugaaguucucccgcaccgagaucaccgccccgaucaugccccuggacugcgcgaacgccaguaacgugcaggccgugaaccgguccgccacgaagggcgucacccuccugcugcccgagcccgaguggaccuacccgcgccucagcugccccggguccaccuuccagaaggcccugcugaucaguccccaccgguucggcgagacgaaggggaacuccgcgccccucaucauccgcgagccguucaucgccugcggccccaaggaguguaagcacuucgcccugacccacuacgccgcgcagcccggcggguacuacaauggcacccgggaggaccgcaacaagcugcggcaccucaucagcgugaagcuggggaagauccccaccguggagaacuccaucuuccauauggccgccuggagcggcuccgccugccacgacgggcgcgaguggacguacaucggcgucgauggcccggacagcaacgcccugcucaagaucaaguacgggggcgcguucaccgacaccuaucacuccuacgccaagaacauccugagcccccaggagagcgccugcaauugcaucgggggcgacugcuaccugaugaucaccgacggccccgccuccgggaucagugagugccgguuccucaagauccgcgagggccggaucaucaaggagaucuuccccacggggcgcgugaagcacaccgaggagugcacgugcggcuuugccuccaacaagaccaucgagugcgcgugccgggacaacucguauaccgccaagcgcccguucgugaagcugaacgucgagaccgacaccgccgagauccggcugaugugcaccgagacguaccucgauacgccccgccccaacgacggguccaucaccggccccugcgagagcaacggcgacaagggguccggcgggaucaagggcggguuugugcaccagcggauggccagcaagaucggccgcugguacucccggaccaugagcaagaccaagcgcaugggcauggggcuguacgugaaguacgauggcgacccguggaccgacuccgaggcccuggcgcucagcggggucaugguguccauggaggagcccggcugguacagcuuuggguucgagaucaaggacaagaagugcgacgugcccugcaucggcaucgagaugguccacgauggcgggaagaccaccuggcacuccgccgccacggccaucuacugccugaugggcagcgggcagcugcucugggacaccgugaccggcgugaacaugacccuguga

SEQ ID NO: 28927 - RNA, 1401 nt, Artificial Sequence
  derived and/or modified CDS sequence (AUadapt) from InfluenzaB__AEA51355__NA
augcugcccaguaccauccaaacccucacgcuguuccugaccuccggcggggugcuccugagccuguacgucuccgccagucucuccuaccugcuguacagcgacauccuccugaaguuuuccccgaccgagaucaccgcccccacgaugccccuggacugcgcgaacaccagcaaugugcaggccgugaaccgcuccgccaccaagggcgucacccuccugcugcccgagccggaguggacguacccccggcucagcugucccggguccaccuuccagaaggcccugcugaucagcccccaccgcuucggcgagaccaaggggaauuccgccccgcucaucauccgggagcccuucaucgcgugcggccccaacgagugcaagcauuucgcccugacccacuacgccgcccagcccggcggguauuacaacggcacgcgcggggaccggaacaagcugcgccaucucaucagcgugaagcugggcaagaucccgaccguggaaaacuccaucuuccacauggcggccuggaguggguccgccugccacgacggcaaggaguggaccuauaucggcgucgacgggcccgacaacaacgcccugcucaagaucaccuauggcgaggccuaccccgggacguaccacagcuaugcgaucaagaacccccggacccaggaguccgccccgaacugcuuuggcggccacagcuuccccaucaucacccacgccccgcccaguggggugugggagccccgcuuccugaagauccgggagggccgcaucaucaacgagaucuuccccaccgggcgggugaagccgcccgaggagugcacguguggcuucgccuccaacaacaccaucgagugugccugccgcgacaacaacuguaccgcgaagcggcccuucgucaaguuccacguggagagcgaucccgccgaaauccgcgccaugugcaccgacacguaccuggauagcccccggcccgacgacggguccaucaccggcccgugcgauuccaacggcgacaaggggagcggcgggaucaagggcggguucgugcaucagcgcauggaguccaagaucggccggugguacagccgcaccauguccaagaccgagcggaugggcauggggcucuacgucaaguaugacggcgaccccugggccgacagcgaugcccuggcgaacuccggggugauggugagcaugaacgagcccggcuccagcuccuuuggguucgagaucaaggacaagaagugcgaugucccgugcaucggcaucgagauggugcacgacggcgggaaggagacguggcacagugccgccaccgccaucuacugccugaugggcuccgggcagcuccugugggacaccgugaccggcgucgacauggcccuguga

SEQ ID NO: 28928 - RNA, 1401 nt, Artificial Sequence
  derived and/or modified CDS sequence (AUadapt) from InfluenzaB__AEA51357__NA
augcugcccaguaccauccagacccucacgcuguuccugaccuccggcggggugcuccugagccuguacgucuccgccagccucuccuaccugcuguauagcgacauccuccugaaguucucccgcaccgagaucaccgccccgaucaugccccuggacugcgcgaacgccaguaacgugcaggccgugaaccgguccgccacgaagggcgucacccuccugcugcccgagcccgaguggaccuacccgcgccucucgugccccggguccaccuuccagaaggcccugcugaucaguccccaccgguucggcgagacgaaggggaacuccgcgccccucaucauccgcgagccguucaucgccugcggccccaaggaguguaagcacuucgcccugacccacuacgccgcgcagcccggcggguacuacaauggcacccgggaggaccgcaacaagcugcggcaccucaucagcgugaagcuggggaagauccccaccguggagaacuccaucuuccauauggccgccuggagcggcuccgccugccacgacgggcgcgaguggacguacaucggcgucgacggcccggauagcaacgcccugcucaagaucaaguucggggaggcguacaccgacaccuaucacuccuacgccaagaacauccugggcacccaggagucggccugcaacuguaucgggggcgacugcaaccugaugaucacggacggccccgccagcgggaucuccgagagccgguuucucaagaucggcgaggggcgcaucaucaaggagaucuuccccaccggccgggugaagcacaccgaggagugcacgugcggguucgccuccaauaagaccaucgagugcgcgugccgcgacaacagcuacaccgccaagcggcccuuugugaagcugaacgucgagaccgacaccgccgagauccgccugaugugcacggagaccuaccucgacaccccgcggcccaacgauggcuccaucaccggccccugcgagagcaacggggacaagggcuccgggggcaucaagggcggguucgugcaccagcgcauggccaguaagaucggccggugguacucccgcacgaugagcaagaccgagcggauggggaugggccuguacgugaaguacgacggggaucccugggccgacuccgacgcgcuggccuucagcggcgucaugguguccaugaaggagccggggugguacagcuuuggcuucgagaucaaggacaagaagugcgacgugcccugcaucggcaucgagaugguccacgaugggggcaaggagaccuggcacuccgccgccaccgccaucuacugccucauggggagcggccagcugcugugggacacggugaccggcgugaacauggcgcucuga

SEQ ID NO: 28929 - RNA, 1401 nt, Artificial Sequence
  derived and/or modified CDS sequence (AUadapt) from InfluenzaB__AEA51359__NA
augcugcccaguaccauccagacccucacgcuguuccugaccuccggcggggugcuccugagccuguacgucuccgccagccucuccuaucugcuguacagcgacauccuccugaaguucucccgcaccgagaucaccgccccgaucaugccccuggacugugcgaacgccagcaacgugcaggccgugaaccgguccgccacgaagggcgucacccuccugcugcccgagcccgaguggaccuacccgcgccucaguugccccggguccaccuuccagaaggcccugcugaucagcccccaccgguucggcgagacgaaggggaauuccgcgccccucaucauccgcgagccguucaucgccugcggccccaaggagugcaagcacuucgcccugacccauuacgccgcgcagcccggcggguacuacaacggcacccgggaggaccgcaauaagcugcggcaccucaucagcgugaagcuggggaagauccccaccguggagaacuccaucuuccacauggccgccuggaguggcuccgccugccacgacgggcgcgaguggacguacaucggcgucgacggcccggauucgaacgcccugcucaagaucaaguacggggaggcguacaccgacaccuaucacuccuacgccaagaacauccugcggacccaggagagcgccugcaauugcaucggcggggacugcuaccugaugaucacggacggccccgccaguggcaucuccgagugccgcuuccucaagauccgggaggggcgcaucaucaaggagaucuuccccaccggccgggugaagcacaccgaggagugcacguguggguucgccagcaacaagaccaucgagugcgcgugccgcgauaacuccuacaccgccaagcggcccuucgugaagcugaacgucgagaccgacaccgccgagauccgccugauguguacggagaccuaccucgacaccccgcggcccaacgacggcagcaucaccgggcccugugaguccgacggcgacaagggcagcgggggcaucaagggcggguucgugcaccagcgcauggccuccaagaucgggcggugguauagccgcacgauguccaagaccaagcggaugggcaugggccuguacgugaaguacgacggggaccccuggaccgauagcgaggcccuggcgcucuccggcgucauggugagcauggaggagccggggugguacuccuucggcuucgagaucaaggauaagaagugcgacgugcccugcaucgggaucgagaugguccacgacggcggcaagaccacguggcauagcgccgccaccgccaucuacugccugaugggguccggccagcugcucugggacaccgugaccgggguggacauggcccuguga

SEQ ID NO: 28930 - RNA, 1401 nt, Artificial Sequence; identical to SEQ ID NO: 28686
  derived and/or modified CDS sequence (AUadapt) from InfluenzaB__AEA51365__NA

SEQ ID NO: 28931 - RNA, 1401 nt, Artificial Sequence; identical to SEQ ID NO: 28686
  derived and/or modified CDS sequence (AUadapt) from InfluenzaB__AEA51367__NA

SEQ ID NO: 28932 - RNA, 1401 nt, Artificial Sequence; identical to SEQ ID NO: 28686
  derived and/or modified CDS sequence (AUadapt) from InfluenzaB__AEA51371__NA

SEQ ID NO: 28933 - RNA, 1401 nt, Artificial Sequence
  derived and/or modified CDS sequence (AUadapt) from InfluenzaB__AEA51373__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccgcuccgccaccaagggcgucacccuccugcugcccgagccggaguggaccuacccccggcucagcugccccggguccacguuccagaaggcccugcugaucucgccccaucgcuucggcgagaccaaggggaacuccgcgccgcucaucauccgggagcccuucaucgccugcggccccaacgagugcaagcauuucgcccugacccacuacgccgcgcagcccggcggguacuacaacggcacccgcggggaucggaacaagcugcgccaccucaucagcgugaagcugggcaagaucccgacgguggagaacuccaucuuccacauggccgccuggagcggguccgccugucacgacggcaaggaguggaccuacaucggcgucgacgggcccgacaacaaugcccugcucaaggugaaguacggcgaggcguacaccgacaccuaccacucguaugccaacaagauccugcggacgcaggaguccgccugcaacugcaucgggggcaacugcuaucugaugaucaccgacggcagcgccagcgggguguccgagugccgcuuccucaagauccgggagggccgcaucaucaaggagaucuuccccaccgggcgggucaagcauaccgaggagugcacgugcggcuucgccucgaacaagaccaucgagugcgcgugucgcgacaacuccuacaccgccaagcggcccuucgugaagcugaacguggagaccgacacggccgagauccgccugaugugcaccgauaccuaccucgacaccccgcggcccgacgacgggagcaucacgggccccugcgaguccaauggcgacaaggggagcggcgggaucaagggcggguucguccaccagcgcauggccuccaagaucggccggugguacucgcgcaccauguccaagaccaagcggaugggcauggggcuguaugugaaguacgacggcgaccccuggaccgacagcgaggcccuggcgcucuccggggugauggucagcauggaggagccgggcugguauuccuucggguucgagaucaaggacaagaagugcgacgugcccugcaucggcaucgagauggugcaugacggcgggaaggagacguggcacagcgccgccaccgccaucuacugccugaugggcuccgggcagcugcucugggacaccgucaccggcgugaacaugacgcuguga

SEQ ID NO: 28934 - RNA, 1401 nt, Artificial Sequence
  derived and/or modified CDS sequence (AUadapt) from InfluenzaB__AEA51377__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaacgaguguaagcacuucgcccugacccacuacgccgcgcagcccggcggguacuacaauggcacccgcggggaccggaacaagcugcgccaccucaucagcgugaagcugggcaagaucccgacgguggagaacuccaucuuccauauggccgccuggagcggguccgccugccacgacggcaaggaguggaccuacaucggcgucgacgggcccgauaacaacgcccugcucaaggugaaguacggcgaggcguacaccgacaccuaccauucguacgccaacaagauccugcggacgcaggaguccgccugcaacugcaucgggggcaauugcuaccugaugaucaccgacggcagcgccagcgggguguccgagugucgcuuccucaagauccgggagggccgcaucaucaaggagaucuuccccaccgggcgggucaagcacaccgaggagugcacgugcggcuucgccaguaacaagaccaucgagugcgcgugccgcgacaacuccuacaccgccaagcggcccuuugugaagcugaacguggagaccgacacggccgagauccgccugaugugcaccgacaccuaccucgacaccccgcggcccgaugacgggagcaucacgggccccugcgaguccaacggcgacaaggggucgggcgggaucaagggcggguuuguccaccagcgcauggaguccaagaucggccggugguacagccgcaccauguccaagaccgagcggaugggcauggggcuguacgugaaguacgacggcgaucccugggccgacagcgacgcccuggcguucuccggggugauggucagcaugaaggagccgggcugguacuccuuuggguucgagaucaaggacaagaagugcgacgugcccugcaucggcaucgagauggugcacgauggcgggaaggagaccuggcacagcgccgccacggccaucuacugccucaugggcuccgggcagcugcugugggacaccgucaccggcguggacauggcccucuga

SEQ ID NO: 28935 - RNA, 1401 nt, Artificial Sequence; identical to SEQ ID NO: 28934
  derived and/or modified CDS sequence (AUadapt) from InfluenzaB__AEA51379__NA

SEQ ID NO: 28936 - RNA, 1401 nt, Artificial Sequence
  derived and/or modified CDS sequence (AUadapt) from InfluenzaB__AEA51381__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaacgaguguaagcacuucgcccugacccacuacgccgcgcagcccggcggguacuacaauggcacccgcggggaccggaacaagcugcgccaccucaucagcgugaagcugggcaagaucccgacgguggagaacuccaucuuccauauggccgccuggagcggguccgccugccacgacggcaaggaguggaccuacaucggcgucgacgggcccgauaacaacgcccugcucaaggugaaguacggcgaggcguacaccgacaccuaccauucguacgccaacaagauccugcggacgcaggaguccgccugcaacugcaucgggggcaauugcuaccugaugaucaccgacggcagcgccagcgggguguccgagugucgcuuccucaagauccgggagggccgcaucaucaaggagaucuuccccaccgggcgggucaagcacaccgaggagugcacgugcggcuucgccaguaacaagaccaucgagugcgcgugccgcgacaacuccuacaccgccaagcggcccuuugugaagcugaacguggagaccgacacggccgagauccgccugaugugcaccgacaccuaccucgacaccccgcggcccaaugacgggagcaucacgggccccugcgaguccgacggcgacaaggggucgggcgggaucaagggcggguuuguccaccagcgcaugaaguccaagaucggccggugguacagccgcaccauguccaagaccgagcggaugggcauggggcuguacgugaaguacgacggcgaucccugggccgacagcgacgcccuggcguucuccggggugauggucagcgugaaggagccgggcugguacuccuuuggguucgagaucaaggacaagaagugcgacgugcccugcaucggcaucgagaugguccacgauggcgggaaggagaccuggcacagcgccgccacggccaucuacugccucaugggcuccgggcagcugcugugggacaccgugaccggcguggacauggcccucuga

SEQ ID NO: 28937 - RNA, 1401 nt, Artificial Sequence; identical to SEQ ID NO: 28934
  derived and/or modified CDS sequence (AUadapt) from InfluenzaB__AEA51383__NA

SEQ ID NO: 28938 - RNA, 1401 nt, Artificial Sequence
  derived and/or modified CDS sequence (AUadapt) from InfluenzaB__AEG20998__NA
augcugcccaguaccauccagacccucacgcuguuccugaccuccggcggggugcuccugagccuguacgucuccgccagccucuccuaucugcuguacagcgacauccuccugaaguucucccgcaccgagaucaccgccccgauccugcggcucgcgugcgccaaugccagcaacgugcaggccgugaaccgcuccgccacgaagggcgucacccugcugcuccccgagcccgaguggaccuacccccggcugagcuguccgggguccaccuuccagaaggcgcugcucaucagcccccaccgcuucggcgagacgaaggggaacuccgcgccccugaucauccgggagcccuuuaucgccugcggcccgaaggagugcaagcacuucgcccugacccacuaugccgcccagcccggcggguacuacaacggcacccgcgaggaccggaacaagcuccgccaucugaucagcgugaagcuggggaagauccccaccguggagaacuccaucuuccacauggccgccuggagcggcuccgccugucacgacgggcgggaguggacguacaucggcgucgacggccccgacaguaacgcgcuccugaagaucaaguacgggggcgccuucaccgacaccuaccauuccuacgccaagaacauccugagcccgcaggagagcgccugcaauugcaucgggggcgacugcuaccucaugaucaccgacggccccgccuccgggaucagugagugccgcuuccugaagauccgggagggccgcaucaucaaggagaucuuccccacggggcgggugaagcacaccgaggagugcacguguggcuucgcguccaacaagaccaucgagugcgccugccgcgacaauagcuacaccgccaagcggcccuucgugaagcugaacgucgagaccgacaccgccgagauccgccucauguguaccgagacguaccuggacaccccgcggcccaacgacggguccaucaccggccccugcgagaguaacggcgacaagggguccggcgggaucaagggcggguucgugcaccagcgcauggccagcaagaucggccggugguauucccgcaccaugagcaagacgaagcggaugggcauggggcuguacgugaaguacgacggcgaccccuggaccgauuccgaggcgcucgcccugagcggggucaugguguccauggaggagccgggcugguacagcuucggguucgagaucaaggauaagaagugcgacgugcccugcaucggcaucgagaugguccacgacggcgggaagaccaccuggcauuccgccgccacggccaucuacugccugaugggcagcgggcagcuccugugggacaccgugaccggcgugaacaugacccuguga

SEQ ID NO: 28939 - RNA, 1401 nt, Artificial Sequence
  derived and/or modified CDS sequence (AUadapt) from InfluenzaB__AEG20999__NA
augcugcccaguaccauccagacccucacgcuguuccugaccuccggcggggugcuccugagccuguccgucagcgccucccucagcuaccugcuguauuccgacauccuccugaaguucagccgcaccgagaucaccgccccgaucaugccccuggacugcgcgaaugccuccaacgugcaggccgugaaccggagcgccacgaagggcgucacccuccugcugcccgagcccgaguggaccuacccgcgccucuccugccccgggaguaccuuccagaaggcccugcugaucagcccccaccgguucggcgagacgaaggggaacuccgcgccccucaucauccgcgagccguucaucgccuguggccccaaggagugcaagcacuucgcccugacccacuacgccgcgcagcccggcggguauuacaacggcacccgggaggaccgcaacaagcugcggcaccucaucuccgugaagcuggggaagauccccaccguggagaauagcaucuuccacauggccgccugguccggcagcgccugccaugacgggcgcgaguggacguacaucggcgucgacggcccggacuccaacgcccugcucaagaucaaguacgggggcgcguuuaccgacaccuaccacucguacgccaagaauauccugagcccccaggaguccgccugcaacugcaucgggggcgacuguuaccugaugaucaccgacggccccgccagcgggaucuccgagugccgguuccucaagauccgcgagggccggaucaucaaggagaucuuucccacggggcgcgugaagcacaccgaggagugcacgugcggcuucgccagcaacaagaccaucgagugugcgugccgggacaacuccuacaccgccaagcgcccguucgugaagcugaaugucgagaccgacaccgccgagauccggcugaugugcaccgagacguaccucgacacgccccgccccaacgaugggagcaucaccggccccugcgaguccaacggcgacaaggggagcggcgggaucaagggcggguuugugcaccagcggauggccuccaagaucggccgcugguacagccggaccauguccaagaccaagcgcaugggcauggggcuguacgugaaguacgacggcgauccguggaccgacagcgaggcccuggcgcucuccggggucauggugagcauggaggagcccggcugguacuccuucggguuugagaucaaggacaagaagugcgacgugcccugcaucggcaucgagaugguccacgauggcgggaagaccaccuggcacagcgccgccacggccaucuacugccugaugggcuccgggcagcugcucugggacaccgugaccggcgugaacaugacccuguga

SEQ ID NO: 28940 - RNA, 1401 nt, Artificial Sequence
  derived and/or modified CDS sequence (AUadapt) from InfluenzaB__AEG21000__NA
augcugcccaguaccauccagacccucacgcuguuccugaccuccggcggggugcuccugagccuguacgucuccgccagccucuccuaccugcuguacagugacauccuccugaaguucucccgcaccgagaucaccgccgcgauccugauccucgacugcgccaacgccagcaaugugcaggccgugaaccgguccgccacgaagggcgucacccugcugcucccggagcccgaguggaccuacccccgccugagcugccccggguccaccuuccagaaggcgcugcucaucucgccgcaucgguucggcgagacgaaggggaacuccgcgccccugaucauccgcgagcccuucaucgccugcggccccaaggagugcaagcacuuugcccugacccacuacgccgcccagccgggcggguacuacaacggcacccgggaggaccgcaauaagcuccggcaccugaucagcgugaagcuggggaagauccccaccguggagaacuccaucuuccacauggccgccuggagcggcuccgccugucacgacgggcgcgaguggacguacaucggcgucgacggccccgacagcaaugcgcuccugaagaucaaguacgggggcgccuucaccgacaccuaccacuccuacgccaagaauauccugagcccccaggagagcgccugcaacugcaucgggggcgacuguuaccucaugaucaccgacggcccggccuccgggaucagcgagugccgguuccugaagauccgcgagggccggaucaucaaggagaucuuccccacggggcgcgugaagcauaccgaggagugcacgugcggcuucgcguccaacaagaccaucgagugcgccugccgggauaacucguacaccgccaagcgccccuucgugaagcugaacgucgagaccgacaccgccgagauccggcucauguguaccgagacguaccuggacacgccccgcccgaacgacggguccaucaccggccccugcgagagcaauggcgacaagggguccggcgggaucaagggcggguucgugcaccagcggauggccagcaagaucggccgcugguacucccggaccaugagcaagaccaagcgcaugggcauggggcuguaugugaaguacgacggcgaccccuggaccgacuccgaggcgcucgcccugagcggggucaugguguccauggaggagcccggcugguacaguuucggguucgagaucaaggacaagaagugcgacgugccgugcaucggcaucgagaugguccaugacggcgggaagaccaccuggcacuccgccgccacggccaucuacugccugaugggcagcgggcagcuccugugggacaccgugaccggcgugaacaugacccuguga

SEQ ID NO: 28941 - RNA, 1401 nt, Artificial Sequence
  derived and/or modified CDS sequence (AUadapt) from InfluenzaB__AEG21002__NA
augcugcccaguaccauccagacccucacgcuguuccugaccuccggcggggugcuccugagccuguacgucuccgccagccucuccuaccugcuguauagcgacauccuccugaaguucucccgcaccgagaucaccgccccgaucaugccccuggacugcgcgaaugccagcaacgugcaggccgugaaccgguccgccacgaagggcgucacccuccugcugcccgagcccgaguggaccuacccgcgccucagcugucccggguccaccuuccagaaggcccugcugaucucgccccaccgguucggcgagacgaaggggaacuccgcgccccucaucauccgcgagccguucaucgccuguggccccaaggagugcaagcacuucgcccugacccacuacgccgcgcagcccggcggguauuacaacggcacccgggaggaccgcaacaagcugcggcaccucaucagugugaagcuggggaagauccccaccguggagaacuccaucuuccacauggccgccuggagcggcuccgccugccaugacgggcgcgaguggacguacaucggcgucgacggcccggacagcaacgcccugcucaagaucaaguauggggaggcguacaccgacaccuaccacuccuacgccaagaauauccugcggacccaggagagcgccugcaacugcaucggcggggacuguuaccugaugaucacggacggccccgccagcggcaucuccgagugccgcuuccucaagauccgggaggggcgcaucaucaaggagaucuuucccaccggccgggugcgccacaccgaggagugcacgugcggguucgccucgaacaagaccaucgagugugcgugccgggacaacuccuacaccgccaagcgccccuucgugaagcugaaugucgagaccgacaccgccgagauccggcugaugugcacggagaccuaccucgacaccccgcgccccaacgauggcagcaucaccgggcccugcgaguccaacggcgacaagggcagcgggggcaucaagggcggguuugugcaccagcggauggccuccaagaucgggcgcugguacagccggacgauguccaagaccaagcgcaugggcaugggccuguacgugaaguacgacggggaucccuggaccgacagcgaggcccuggcgcucuccggcgucauggugagcauggaggagccggggugguacuccuucggcuuugagaucaaggacaagaagugcgacgugcccugcaucgggaucgagaugguccacgauggcggcaagaccacguggcacagcgccgccaccgccaucuacugccugaugggguccggccagcugcucugggacaccgugaccggggugaacaugacgcuguga

SEQ ID NO: 28942 - RNA, 1401 nt, Artificial Sequence
  derived and/or modified CDS sequence (AUadapt) from InfluenzaB__AEG21003__NA
augcugcccaguaccauccagacccucacgcuguuccugaccuccggcggggugcuccugagccuguacgucuccgccagccucuccuaccugcuguauagcgacauccuccugaaguucucccgcaccgagaucaccgccccgaucaugccccuggacugcgcgaacgccaguaacgugcaggccgugaaccgguccgccacgaagggcgucacccuccugcugcccgagcccgaguggaccuacccgcgccucagcugccccggguccaccuuucagaaggcccugcugaucagcccccaccgguucggcgagacgaaggggaacuccgcgccccucaucauccgcgagccguucaucgccugcggccccaaggaguguaagcacuucgcccugacccacuacgccgcgcagcccggcggguacuacaauggcacccgggaggaccgcaacaagcugcggcaccucaucagcgugaagcuggggaagauccccaccguggagaacuccaucuuucacauggccgccuggagcggcuccgccugccacgacgggcgcgaguggacguacaucggcgucgauggcccggacucgaacgcccugcucaagaucaaguacggggaggcguacaccgauaccuaccacuccuacgccaagaacauccugcggacccaggagagcgccugcaauugcaucggcggggacugcuaccugaugaucacggacggccccgccagcggcaucuccgagugucgcuuccucaagauccgggaggggcgcaucaucaaggagaucuuccccaccggccgggugaagcacaccgaggagugcacgugcggguuugccagcaacaagaccaucgagugcgcgugccgcgacaacuccuauaccgccaagcggcccuucgugaagcugaacgucgagaccgacaccgccgagauccgccugaugugcacggagaccuaccucgauaccccgcggcccaacgacggcagcaucaccgggcccugcgaguccgacggcgacaagggcagugggggcaucaagggcggguucgugcaccagcgcauggccuccaagaucgggcggugguacagccgcacgauguccaagaccaagcggaugggcaugggccuguacgugaaguacgauggggaccccuggaccgacagcgaggcccuggcgcucuccggcgucauggugagcauggaggagccggggugguacuccuuuggcuucgagaucaaggacaagaagugcgacgugcccugcaucgggaucgagaugguccacgauggcggcaagaccacguggcacagcgccgccaccgccaucuacugccugaugggguccggccagcugcucugggacaccgugaccggggugaacaugacgcuguga

SEQ ID NO: 28943 - RNA, 1401 nt, Artificial Sequence
  derived and/or modified CDS sequence (AUadapt) from InfluenzaB__AEG21004__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuucagaaggcccugcugaucagcccccaccgcuucggcgagaccaaggggaacuccgcgccgcucaucauccgggagcccuucaucgccugcggccccaaugagugcaagcacuucgcccugacccacuacgccgcgcagcccggcggguauuacaacggcacccgcggggaccggaacaagcugcgccaccucaucagcgugaagcugggcaagaucccgacgguggagaauuccaucuuccacauggccgccuggagcggguccgccugccacgauggcaaggaguggaccuacaucggcgucgacgggcccgacaacaacgcccugcucaaggugaaguacggcgaggcguauaccgacaccuaccacucguacgccaauaagauccugcggacgcaggaguccgccugcaacugcaucgggggcaacugcuaccugaugaucaccgauggcagcgccagcgggguguccgagugccgcuuccucaagauccgggagggccgcaucaucaaggagaucuuccccaccgggcgggucaagcauaccgaggagugcacgugcggcuucgccagcaacaagaccaucgagugcgcgugucgcgacaacuccuacaccgccaagcggcccuucgugaagcugaacguggagaccgauacggccgagauccgccugaugugcaccgacaccuaccucgacaccccgcggcccgacgacgggaguaucacgggccccugcgaguccaacggcgacaagggcggcgggggcaucaagggcggguucguccaccagcgcauggagaguaagaucgggcggugguacucccgcaccaugagcaagaccgagcggauggggaugggccuguacgugaaguacgacggggaccccugggccgauuccgacgcccuggcguucagcggcgugauggucuccaugaaggagccggggugguacagcuuuggcuucgagaucaaggacaagaagugcgacgugcccugcaucggcaucgagauggugcacgaugggggcaaggagaccuggcacuccgccgccacggccaucuacugccucauggggagcggccagcugcugugggacaccgucaccggcguggacauggcccucuga

SEQ ID NO: 28944 - RNA, 1401 nt, Artificial Sequence
  derived and/or modified CDS sequence (AUadapt) from InfluenzaB__AEG21005__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccgcuccgccaccaagggcgucacccuccugcugcccgagccggaguggaccuacccccggcucagcugccccggguccacguuccagaaggcccugcugaucucgccccaucgcuucggcgagaccaaggggaacuccgcgccgcucaucauccgggagcccuucaucgccugcggccccaacgagugcaagcacuuugcccugacccacuacgccgcgcagcccggcggguacuacaacggcacccgcggggaccggaauaagcugcgccaccucaucagcgugaagcugggcaagaucccgacgguggagaacuccaucuuccacauggccgccuggagcggguccgccugucacgacggcaaggaguggaccuacaucggcgucgacgggcccgacaacaacgcccugcucaaggugaaguauggcgaggcguacaccgacaccuaccacucguacgccaauaagauccugcggacgcaggaguccgccugcaacugcaucgggggcaacugcuaccugaugaucaccgauggcagcgccagcgggguguccgagugccgcuuccucaagauccgggagggccgcaucaucaaggagaucuuccccaccgggcgggucaagcacaccgaggaguguacgugcggcuucgccucgaacaagaccaucgagugcgcgugccgcgacaauuccuacaccgccaagcggcccuucgugaagcugaacguggagaccgacacggccgagauccgccugaugugcaccgacaccuaucucgacaccccgcggcccgacgacgggagcaucacgggccccugcgaguccaacggcgauaagggcggcgggggcaucaagggcggguucguccaccagcgcauggagagcaagaucgggcggugguacucccgcaccaugucgaagaccgagcggauggggaugggccuguacgugaaguacgauggggaccccugggccgacuccgacgcccuggcguucagcggcgugauggucuccaugaaggagccggggugguacaguuucggcuucgagaucaaggacaagaagugcgacgugcccugcaucggcaucgagauggugcaugacgggggcaaggagaccuggcacuccgccgccacggccaucuacugccucauggggagcggccagcugcugugggacaccgucaccggcgugaacaugacccucuga

SEQ ID NO: 28945 - RNA, 1401 nt, Artificial Sequence; identical to SEQ ID NO: 28686
  derived and/or modified CDS sequence (AUadapt) from InfluenzaB__AEG21006__NA

SEQ ID NO: 28946 - RNA, 1401 nt, Artificial Sequence; identical to SEQ ID NO: 28934
  derived and/or modified CDS sequence (AUadapt) from InfluenzaB__AEG21007__NA

SEQ ID NO: 28947 - RNA, 1401 nt, Artificial Sequence
  derived and/or modified CDS sequence (AUadapt) from InfluenzaB__AEG21008__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaacgaguguaagcacuucgcccugacccacuacgccgcgcagcccggcggguacuacaauggcacccgcggggaccggaacaagcugcgccaccucaucagcgugaagcugggcaagaucccgacgguggagaacuccaucuuccauauggccgccuggagcggguccgccugccacgacggcaaggaguggaccuacaucggcgucgacgggcccgauaacaacgcccugcucaaggugaaguacggcgaggcguacaccgacaccuaccauucguacgccaacaagauccugcggacgcaggaguccgccugcaacugcaucgggggcaauugcuaccugaugaucaccgacggcagcgccagcgggguguccgagugucgcuuccucaagauccgggagggccgcaucaucaaggagaucuuccccaccgggcgggucaagcacaccgaggagugcacgugcggcuucgccaguaacaagaccaucgagugcgcgugccgcgacaacuccuacaccgccaagcggcccuuugugaagcugaacguggagaccgacacggccgagauccgccugaugugcaccgacaccuaccucgacaccccgcggcccgaugacgggagcaucacgggccccugcgaguccaacggcgacaaggggucgggcgggaucaagggcggguuuguccaccagcgcauggccuccaagaucggccggugguacagccgcaccauguccaagaccaagcggaugggcauggggcuguacgugaaguacgacggcgaucccugggccgacagcgacgcgcuggccuucuccggggugauggucagcaugaaggagccgggcugguacuccuuuggguucgagaucaaggacaagaagugcgacgugcccugcaucggcaucgagauggugcacgauggcgggaaggagaccuggcacagcgccgccacggccaucuacugccucaugggcuccgggcagcugcugugggacaccgucaccggcguggacauggcgcucuga

SEQ ID NO: 28948 - RNA, 1401 nt, Artificial Sequence; identical to SEQ ID NO: 28934
  derived and/or modified CDS sequence (AUadapt) from InfluenzaB__AEG21009__NA

SEQ ID NO: 28949 - RNA, 1401 nt, Artificial Sequence; identical to SEQ ID NO: 28934
  derived and/or modified CDS sequence (AUadapt) from InfluenzaB__AEG21010__NA

SEQ ID NO: 28950 - RNA, 1401 nt, Artificial Sequence; identical to SEQ ID NO: 28934
  derived and/or modified CDS sequence (AUadapt) from InfluenzaB__AEG21011__NA

SEQ ID NO: 28951 - RNA, 1401 nt, Artificial Sequence; identical to SEQ ID NO: 28934
  derived and/or modified CDS sequence (AUadapt) from InfluenzaB__AEG21012__NA

SEQ ID NO: 28952 - RNA, 1401 nt, Artificial Sequence
  derived and/or modified CDS sequence (AUadapt) from InfluenzaB__AEG21013__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccgcuccgccaccaagggcgucacccuccugcugcccgagccggaguggaccuacccccggcucagcugccccggguccacguuccagaaggcccugcugaucagcccccaucgcuucggcgagaccaaggggaacuccgcgccgcucaucauccgggagcccuucaucgccugcggccccaacgagugcaagcacuuugcccugacccacuacgccgcgcagcccggcggguacuacaacggcacccgcggggaccggaauaagcugcgccaccucaucucggugaagcugggcaagaucccgacgguggagaacuccaucuuccacauggccgccuggagcggguccgccugucacgacggcaaggaguggaccuacaucggcgucgacgggcccgacaacaacgcccugcucaaggugaaguauggcgaggcguacaccgacaccuaccacagcuacgccaauaagauccugcggacgcaggaguccgccugcaacugcaucgggggcaacugcuaccugaugaucaccgauggcagcgccucggggguguccgagugccgcuuccucaagauccgggagggccgcaucaucaaggagaucuuccccaccgggcgggucaagcacaccgaggaguguacgugcggcuucgccagcaacaagaccaucgagugcgcgugccgcgacaauuccuacaccgccaagcggcccuucgugaagcugaacguggagaccgacacggccgagauccgccugaugugcaccgacaccuaucucgacaccccgcggcccaacgacgggagcaucacgggccccugcgaguccgacggcgauaaggggagcggcgggaucaagggcggguucguccaccagcgcaugaaguccaagaucggccggugguacucgcgcaccauguccaagaccgagcggaugggcauggggcuguacgugaaguacgauggcgaccccugggccgacagcgacgcccuggcguucuccggggugauggucagcaugaaggagccgggcugguauuccuucggguucgagaucaaggacaagaagugcgacgugcccugcaucggcaucgagauggugcaugacggcgggaaggagaccuggcacagcgccgccacggccaucuacugccucaugggcuccgggcagcugcugugggacaccgucaccggcguggacauggcccucuga

SEQ ID NO: 28953 - RNA, 1401 nt, Artificial Sequence
  derived and/or modified CDS sequence (AUadapt) from InfluenzaB__AEN68957__NA
augcugcccaguaccauccagacccucacgcuguuccugaccuccggcggggugcuccugagccuguacgucuccgccagccucuccuaccugcuguacagugacauccuccugaaguucucccgcaccgagaucccggcccccaucaugccccuggacugcgcgaacgccagcaaugugcaggccgugaaccgguccgccaccaagggcgucacgcuccugcugcccgagccggaguggaccuacccccgccucagcugccccggguccaccuuccagaaggcccugcugaucagcccccaccgguuuggcgagaccaaggggaacuccgcgccgcucaucauccgcgagcccuucaucgccugcggccccaaggagugcaagcacuucgcccugacgcauuacgccgcgcagcccggcggguacuacaacggcacccgggaggaccgcaacaagaugcggcaccugaucagugugaagcucgggaagaucccgaccguggagaacuccaucuuccacauggccgccuggagcggcuccgccugccacgaugggcgcgaguggaccuacaucggcgucgacggccccgacagcaacgcccugcugaagaucaaguacggggaggcguacacggauaccuaccacuccuacgccaagaacauccuccggacccaggagagcgccugcaauugcaucggcggggacugcuaccugaugaucaccgacggccccgccucgggcaucuccgagugucgcuuccugaagauccgggaggggcgcaucaucaaggagaucuuccccacgggccgggugaaguacaccgaggagugcacgugcggguucgccagcaauaagaccaucggcugcgcgugccgcgacaacuccuacaccgccaagcggccguucgugaagcucaaugucgagaccgacaccgccgagauccgccugaugugcaccgagacguaccuggacacgccccggcccaacgacgggagcaucaccggccccugugaguccaacggcgacaaggggagcggcgggaucaagggcggguucgugcaccagcgcauggccuccaagaucggccggugguacagucgcaccauguccaagaccaagcggaugggcauggggcucuacgugaaguacgacggcgacccguggaccgacagcgaggcccuggcgcuguccggggucauggugagcauggaggagcccggcugguauuccuucggguucgagaucaaggacaagaagugcgacgugcccugcaucggcaucgagaugguccaugacggcgggaagaccaccuggcacagcgccgccacggccaucuacugccucaugggcuccgggcagcugaugugggacaccgugaccggcgugaacaugacccuguga

SEQ ID NO: 28954 - RNA, 1401 nt, Artificial Sequence
  derived and/or modified CDS sequence (AUadapt) from InfluenzaB__AEO80071__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccucgaaugugcacgccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaacgaguguaagcacuucgcccugacccacuacgccgcgcagcccggcggguacuacaauggcacccgcggggaccggaacaagcugcgccaccucaucagcgugaagcugggcaagaucccgacgguggagaacuccaucuuccauauggccgccuggagcggguccgccugccacgacggcaaggaguggaccuacaucggcgucgacgggcccgauaacaacgcccugcucaagaucaaguacggcgaggcguacaccgacaccuaccauucguacgccaacaacauccugcggacgcaggaguccgccugcaacuguaucgggggcaacugcuaccugaugaucaccgacggcagcgccagcgggguguccgagugucgcuuccucaagauccgggagggccgcaucaucaaggagaucuuccccaccgggcgggugaagcacaccgaggagugcacgugcggcuucgccaguaacaagaccaucgagugcgcgugccgcgacaacuccuacaccgccaagcggcccuuugucaagcugaacguggagaccgacacggccgagauccgccugaugugcaccgacaccuaccucgacaccccgcggcccgaugacgggagcaucacgggccccugcgaguccaacggcgacaaggggucgggcgggaucaagggcggguuugugcaccagcgcauggccuccaagaucggccggugguacagccgcaccauguccaagaccgagcggaugggcauggggcuguacgucaaguacgacggcgaucccugggccgacagcgacgcgcuggccuucuccggggugauggugagcaugaaggagccgggcugguacuccuuuggguucgagaucaaggacaagaagugcgacguccccugcaucggcaucgagauggugcacgauggcgggaaggagaccuggcacagcgccgccacggccaucuacugccucaugggcuccgggcagcugcugugggacaccgugaccggcgucgacauggcgcucuga

SEQ ID NO: 28955 - RNA, 1401 nt, Artificial Sequence
  derived and/or modified CDS sequence (AUadapt) from InfluenzaB__AEO80082__NA
augcugcccaguaccauccagacccucacgcuguuccugaccuccggcggggugcuccugagccuguacgucuccgccagccucuccuaccugcuguauagcgacauccuccugaaguucucccagaccggcaucaccgccccgaucaugccccuggacugcgcgaacgccaguaacgugcaggccgugaaccgcuccgccacgaagggggucacccuccugcugcccgagcccgaguggaccuacccgcggcucagcugccccggcuccaccuuucagaaggcccugcugaucucgccccaccgcuucggggagacgaagggcaacuccgcgccccucaucauccgggagccguucaucgccugcggccccaccgaguguaaguacuucgcccugacccacuacgccgcgcagcccgggggcuacuacaaugggacccgcgaggaccggaacaagcugcgccaccucaucagcgugaagcugggcaagauccccacgguggagaacuccaucuuucacauggccgccuggagcggguccgccugccacgacggcaaggaguggaccuacaucggcgucgaugggccggacagcaacgcccugcucaagaucaaguacggcgaggcguacaccgauaccuaccacuccuacgccaagaacauccugcggacgcaggagagcgccugcaauugcaucgggggcgacugcuaccugaugaucaccgacggccccgccagcgggaucuccgagugucgcuuccucaagauccgggagggccgcaucaucaaggagaucuuccccaccgggcgggugaagcacaccgaggagugcacgugcggcuuugccucgaacaagaccaucgagugcgcgugccgcgacaacuccuauaccgccaagcggcccuucgugaagcugaacgucgagaccgacacggccgagauccgccugaugugcaccgagaccuaccucgauaccccgcggcccaacgacgggagcaucacgggccccugcgaguccgacggcgacaaggggaguggcgggaucaagggcggguucgugcaccagcgcauggccuccaagaucggccggugguacagccgcaccauguccaagaccaagcggaugggcauggggcuguacgugaaguacgauggcgaccccuggaccgacagcgaggcccuggcgcucuccggggucauggugagcauggaggagccgggcugguacuccuuuggguucgagaucaaggacaagaagugcgacgugcccugcaucggcaucgagaugguccacgauggcgggaagacgaccuggcacagcgccgccaccgccaucuacugccugaugggcuccgggcagcugcucugggacaccgugacgggcguggacauggcccuguga

SEQ ID NO: 28956 - RNA, 1401 nt, Artificial Sequence; identical to SEQ ID NO: 28795
  derived and/or modified CDS sequence (AUadapt) from InfluenzaB__AEO80090__NA

SEQ ID NO: 28957 - RNA, 1401 nt, Artificial Sequence; identical to SEQ ID NO: 28740
  derived and/or modified CDS sequence (AUadapt) from InfluenzaB__AEO80101__NA

SEQ ID NO: 28958 - RNA, 1401 nt, Artificial Sequence; identical to SEQ ID NO: 28836
  derived and/or modified CDS sequence (AUadapt) from InfluenzaB__AEO80149__NA

SEQ ID NO: 28959 - RNA, 1401 nt, Artificial Sequence; identical to SEQ ID NO: 28748
  derived and/or modified CDS sequence (AUadapt) from InfluenzaB__AEO80158__NA

SEQ ID NO: 28960 - RNA, 1401 nt, Artificial Sequence; identical to SEQ ID NO: 28748
  derived and/or modified CDS sequence (AUadapt) from InfluenzaB__AEO80167__NA

SEQ ID NO: 28961 - RNA, 1401 nt, Artificial Sequence; identical to SEQ ID NO: 28836
  derived and/or modified CDS sequence (AUadapt) from InfluenzaB__AEO80176__NA

SEQ ID NO: 28962 - RNA, 1401 nt, Artificial Sequence
  derived and/or modified CDS sequence (AUadapt) from InfluenzaB__AEO80187__NA
augcugcccaguaccauccagacccucacgcuguuccugaccuccggcggggugcuccugagccuguacgucuccgccagccucuccuaucugcuguacagcgacauccuccugaaguucuccccgaccgagaucaccgcccccacgaugccccugggcugcgcgaaugccagcaacgugcaggccgugaaccgcuccgccaccaagggggucacccuccugcugcccgagccggaguggaccuacccccggcucagcugucccggcuccacguuccagaaggcccugcugaucagcccccaccgcuucggggagaccaagggcaacuccgcgccgcucaucauccgggagcccuuuaucgccugcggccccaacgagugcaagcacuucgcccugacccauuacgccgcgcagcccgggggcuacuacaacgggacccgcggcgaccggaauaagcugcgccaccucaucagcgugaagcuggggaagaucccgacgguggagaacuccaucuuccacauggccgccuggaguggcuccgccugccacgacggcaaggaguggaccuacaucggggucgauggccccgacaacaacgcccugcucaagaucaaguacggggaggcguacaccgauaccuaccacagcuacgccaacaagauccugcggacgcaggaguccgccuguaacugcaucggcggcaacugcuaccugaugaucaccgaugggagcgccagcggcguguccgagugccgcuuccucaagauccgggaggggcgcaucaucaaggagaucuuccccaccggccgggugaagcauaccgaggagugcacgugcggguucgccagcaacaagaccaucgagugugcgugccgcgacaacuccuacaccgccaagcggcccuucgucaagcugaauguggagaccgacacggccgagauccgccugaugugcaccgacaccuaccucgauaccccgcggcccgacgacggcagcaucacgggccccugcgaguccaacggggaucgcggcagcgggggcaucaagggcggguucgugcaccagcggauggccuccaagaucggccgcugguacagccggaccauguccaagaccgagcgcauggggaugggccuguaugucaaguacgacggggaccccugggccgacagcgaugcgcuggccuucuccggcgugauggugagcaugaaggagccggggugguacuccuucggcuucgagaucaaggauaagaagugcgacguccccugcaucggcaucgagauggugcacgacgggggcaaggagaccuggcauagcgccgccacggccaucuacugccucaugggguccggccagcugcugugggacaccgugaccggcgucgacauggcgcucuga

SEQ ID NO: 28963 - RNA, 1401 nt, Artificial Sequence
  derived and/or modified CDS sequence (AUadapt) from InfluenzaB__AEO80198__NA
augcugcccaguaccauccagacccucacgcuguuccugaccuccggcggggugcuccugagccuguacgucuccgccagccucuccuaucugcuguacagcgacauccuccugaaguucuccccgaccgagaucaccgcccccacgaugccccuggacugugcgaacgccagcaacgugcaggccgugaaccgguccgccaccaagggcgucacccuccugcugcccgagccggaguggaccuacccccggcucaguugccccggguccacguuccagaaggcccugcugaucagcccccaccgcuucggcgagaccaaggggaauuccgcgccgcucaucauccgggagcccuucaucgccugcggccccaacgagugcaagcacuuugcccugacccacuacgccgcgcagcccggcggguacuacaacggcacccgcggggaucggaacaagcugcgccaccucaucagcgugaagcugggcaagaucccgacgguggagaacuccaucuuccauauggccgccuggagcggguccgccugccacgacggcaaggaguggaccuacaucggcgucgaugggcccgacaacaacgcccugcucaagaucaaguacggcgaggcguacaccgauaccuaccacucguacgccaacaagauccugcggacgcaggaguccgccuguaacugcaucgggggcaacugcuaucugaugaucaccgacggcagcgccagcgggguguccgagugccgcuuccucaagauccgggagggccgcaucaucaaggagaucuuucccaccgggcgggugaagcacaccgaggagugcacgugcggcuucgccagcaauaagaccaucgagugcgcgugccgcgacaacuccuacaccgccaagcggcccuuugucaagcugaacguggagaccgacacggccgagauccgccugaugugcaccgacaccuaccucgauaccccgcggcccgacgacgggagcaucacgggccccugcgaguccaacggcgaucgcgggagcggcgggaucaagggcggguucgugcaccagcggauggccuccaagaucggccgcugguacagccggaccauguccaagaccgagcgcaugggcauggggcuguaugucaaguacgacggcgaccccugggccgacagcgaugcgcuggccuuccgcggggugaugguguccaugaaggagccgggcugguacagcuucggguucgagaucaaggauaagaagugcgacguccccugcaucggcaucgagauggugcacgacggcgggaaggagaccuggcauuccgccgccacggccaucuacugccucaugggcagcgggcagcugcugugggacaccgugaccggcgucgacauggcgcucuga

SEQ ID NO: 28964 - RNA, 1401 nt, Artificial Sequence; identical to SEQ ID NO: 28904
  derived and/or modified CDS sequence (AUadapt) from InfluenzaB__AEO80209__NA

SEQ ID NO: 28965 - RNA, 1401 nt, Artificial Sequence
  derived and/or modified CDS sequence (AUadapt) from InfluenzaB__AEO80220__NA
augcugcccaguaccauccagacccucacgcuguuccugaccuccggcggggugcuccugagccuguacgucuccgccagccucuccuaucugcuguacagcgacauccuccugaaguucuccccgaccgagaucaccgcccccacgaugccccuggacugugcgaacgccagcaacgugcaggccgugaaccgcuccgccaccaagggccucacccugcugcuccccgagccggaguggaccuacccccggcugaguugccccggguccacguuccagaaggcccugcucaucagcccccaccgcuucggcgagaccaaggggaauuccgcgccgcugaucauccgggagcccuucaucgccugcggccccaacgagugcaagcacuuugcccugacccacuacgccgcgcagcccggcggguacuacaacggcacccgcggggaucggaacaagcuccgccaccugaucagcgucaagcugggcaagaucccgacgguggagaccuccaucuuccacauggccgccuggaguggguccgccugccacgacggcaaggaguggaccuacaucggcguggaugggcccgacaacaacgcccuccugaagaucaaguacggcgaggcguacaccgauacguaccacagcuacgccaacaagauccugcggacccaggaguccgccuguaacugcaucgggggcaacugcuaccucaugaucaccgauggcagcgccagcggggucuccgagugccgcuuccugaagauccgggagggccgcaucaucaaggagaucuuccccaccgggcgggugaagcauacggaggagugcacgugcggcuucgccagcaacaagaccaucgagugugcgugccgcgacaacuccuacaccgccaagcggcccuucgugaagcugaaugucgagaccgacaccgccgagauccgccucaugugcaccgacaccuaccuggauacgccgcggcccgacgacgggagcaucaccggccccugcgaguccaacggcgaucgcgggagcggcgggaucaagggcggguucgugcaccagcggauggccuccaagaucggccgcugguacagccggaccauguccaagaccgagcgcaugggcauggggcuguaugugaaguacgacggcgaccccugggccgacagcgaugcgcucgccuucuccggggucauggugagcaugaaggagccgggcugguacuccuucggguucgagaucaaggauaagaagugcgacgugcccugcaucggcaucgagaugguccacgacggcgggaaggagacguggcauagcgccgccaccgccaucuacugccugaugggcuccgggcagcugcucugggacaccgugaccggcguggacauggcgcuguga

SEQ ID NO: 28966 - RNA, 1401 nt, Artificial Sequence; identical to SEQ ID NO: 28901
  derived and/or modified CDS sequence (AUadapt) from InfluenzaB__AEO80231__NA

SEQ ID NO: 28967 - RNA, 1401 nt, Artificial Sequence; identical to SEQ ID NO: 28904
  derived and/or modified CDS sequence (AUadapt) from InfluenzaB__AEO80242__NA

SEQ ID NO: 28968 - RNA, 1401 nt, Artificial Sequence; identical to SEQ ID NO: 28748
  derived and/or modified CDS sequence (AUadapt) from InfluenzaB__AEP20182__NA

SEQ ID NO: 28969 - RNA, 1401 nt, Artificial Sequence
  derived and/or modified CDS sequence (AUadapt) from InfluenzaB__AEP20193__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcacgccgugaaccgcuccgccaccaagggcgucacccuccugcugcccgagccggaguggaccuacccccggcucagcugucccggguccacguuccagaaggcccugcugaucucgccccaccgcuucggcgagaccaaggggaacuccgcgccgcucaucauccgggagcccuucaucgccuguggccccaacgagugcaagcacuucgcccugacccacuacgccgcgcagcccggcggguauuacaacggcacccgcggggaccggaacaagcugcgccaccucaucagugugaagcugggcaagaucccgacgguggagaacuccaucuuccacauggccgccuggagcggguccgccugccacgauggcaaggaguggaccuacaucggcgucgacgggcccgacaacaacgcccugcucaagaucaaguacggcgaggcguauaccgacaccuaccacagcuacgccaauaacauccugcggacgcaggaguccgccugcaacugcaucgggggcaacugcuaucugaugaucaccgacggcagcgccagcgggguguccgagugccgcuuccucaagauccgggagggccgcaucaucaaggagaucuuucccaccgggcgggugaagcacaccgaggagugcacgugcggcuucgccucgaacaagaccaucgagugugcgugccgcgacaacuccuacaccgccaagcggcccuucgucaagcugaacguggagaccgauacggccgagauccgccugaugugcaccgacaccuaccucgacaccccgcggcccgacgaugggagcaucacgggccccugcgaguccaacggcgacaaggggagcggcgggaucaagggcggguucgugcaucagcgcauggccuccaagaucggccggugguacagccgcaccauguccaagaccgagcggaugggcauggggcuguacgucaaguacgacggcgaccccugggccgauagcgacgcgcuggccuucuccggggugauggugagcgucaaggagccgggcugguacuccuuuggguucgagaucaaggacaagaagugcgacgugcccugcaucggcaucgagauggugcacgauggcgggaaggagaccuggcacagcgccgccacggccaucuacugccucaugggcuccgggcagcugcugugggacaccgucaccggcguggacauggcgcucuga

SEQ ID NO: 28970 - RNA, 1401 nt, Artificial Sequence
  derived and/or modified CDS sequence (AUadapt) from InfluenzaB__AEP20204__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaacgaguguaagcacuucgcccugacccacuacgccgcgcagcccggcggguacuacaauggcacccgcggggaccggaacaagcugcgccaccucaucagcgugaagcugggcaagaucccgacgguggagaacuccaucuuccauauggccgccuggagcggguccgccugccacgacggcaaggaguggaccuacaucggcgucgacgggcccgauaacaacgcccugcucaagaucaaguacggcgaggcguacaccgacaccuaccauucguacgccaacaagauccugcggacgcaggaguccgccugcaacugcaucgggggcaauugcuaccugaugaucaccgacggcagcgccagcgggguguccgagugucgcuuccucaagauccgggagggccgcaucaucaaggagaucuuccccaccgggcgggugaagcacaccgaggagugcacgugcggcuucgccaguaacaagaccaucgagugcgcgugccgcgacaacuccuacaccgccaagcggcccuuugucaagcugaacguggagaccgacacggccgagauccgccugaugugcaccgacaccuaccucgacaccccgcggcccgaugacgggagcaucacgggccccugcgaguccaacggcgacaaggggucgggcgggaucaagggcggguuugugcaccagcgcauggccuccaagaucggccggugguacagccgcaccauguccaagaccgagcggaugggcauggggcuguacgucaaguacgacggcgaucccugggccgacagcgacgcgcuggccuucuccggggugauggugagcaucaaggagccgggcugguacuccuuuggguucgagaucaaggacaagaagugcgacguccccugcaucggcaucgagauggugcacgauggcgggaaggagaccuggcacagcgccgccacggccaucuacugccucaugggcuccgggcagcugcugugggacaccgugaccggcgucgacauggcgcucuga

SEQ ID NO: 28971 - RNA, 1401 nt, Artificial Sequence; identical to SEQ ID NO: 28800
  derived and/or modified CDS sequence (AUadapt) from InfluenzaB__AEP20215__NA

SEQ ID NO: 28972 - RNA, 1401 nt, Artificial Sequence
  derived and/or modified CDS sequence (AUadapt) from InfluenzaB__AEP20237__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccagcaacgugcaggccgugaaccgcuccgccaccaagggcgucacccuccugcugcccgagccggaguggaccuacccccggcucucgugccccggguccacguuucagaaggcccugcugaucagcccccaccgcuucggcgagaccaaggggaacuccgcgccgcucaucauccgggagcccuucaucgccuguggccccaaggagugcaagcacuucgcccugacccacuacgccgcgcagcccggcggguacuauaacggcacccgcggggaccggaacaagcugcgccaccucaucagcgugaagcugggcaagaucccgacgguggagaauuccaucuuccacauggccgccuggagcggguccgccugccacgauggcaaggaguggaccuacaucggcgucgacgggcccgacagcaacgcccugcucaagaucaaguacggcgaggcguauaccgacaccuaccacuccuacgccaacaauauccugcggacgcaggagucggccugcaacugcaucgggggcaacugcuaucugaugaucaccgacggcagcgccuccgggaucagcgagugccgcuuccucaagauccgggagggccgcaucaucaaggagaucuuucccaccgggcgggugaagcacaccgaggagugcacgugcggcuucgccuccaacaagaccaucgagugcgcgugucgcgacaacagcuacaccgccaagcggcccuucgugaagcugaaugucgagaccgacgccgccgagauccgccugaugugcacggagaccuaccucgacaccccgcggcccgacgauggguccaucaccggccccugcgagagcaacggcgacaagggguccggcgggaucaagggcggguucgugcaccagcgcauggccaguaagaucggccggugguacucccgcacgaugagcaagaccaagcggaugggcauggggcuguacgugaaguacgacggcgaucccuggaccgacuccgacgcgcuggcccucagcggggucaugguguccauggaggagccgggcugguacagcuucggguuugagaucaaggacaagaagugcgacgugcccugcaucggcaucgagaugguccacgauggcgggaaggagaccuggcacuccgccgccacggccaucuacugccugaugggcagcgggcagcugcucugggacaccgugaccggcguggacauggcgcuguga

SEQ ID NO: 28973 - RNA, 1401 nt, Artificial Sequence; identical to SEQ ID NO: 28800
  derived and/or modified CDS sequence (AUadapt) from InfluenzaB__AEP20248__NA

SEQ ID NO: 28974 - RNA, 1401 nt, Artificial Sequence
  derived and/or modified CDS sequence (AUadapt) from InfluenzaB__AEP20259__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccagcaacgugcaggccgugaaccgcuccgccaccaagggcgucacccuccugcugcccgagccggaguggaccuacccccggcucagcugccccggguccacguuucagaaggcccugcugaucucgccccaccgcuucggcgagaccaaggggaacuccgcgccgcucaucauccgggagcccuucaucgccuguggccccaacgagugcaagcacuucgcccugacccacuacgccgcgcagcccggcggguauuacaacggcacccgcggggaccggaacaagcugcgccaccucaucagugugaagcugggcaagaucccgacgguggagaacuccaucuuccacauggccgccuggagcggguccgccugccacgauggcaaggaguggaccuacaucggcgucgacgggcccgacaacaacgcccugcucaagaucaaguauggcgaggcguacaccgacaccuaccacagcuacgccaauaacauccugcggacgcaggaguccgccugcaacugcaucgggggcaacuguuaccugaugaucaccgacggcagcgccagcgggguguccgagugccgcuuccucaagauccgggagggccgcaucaucaaggagaucuuucccaccgggcgggugaagcacaccgaggagugcacgugcggcuucgccucgaauaagaucaucgagugcgcgugccgcgacaacuccuacaccgccaagcggcccuucgucaagcugaauguggagaccgacaccgccgagauccgccugaugugcacggagaccuaccucgacaccccgcggcccgacgaugggagcaucaccggccccugcgaguccaacggcgacaaggggagcggcgggaucaagggcggguucgugcaucagcgcauggccuccaagaucggccggugguacagccgcacgauguccaagaccgagcggaugggcauggggcuguacgucaaguacgacggcgaucccugggccgacagcgacgcgcuggcccucuccggggugauggugagcauggaggagccgggcugguacuccuucggguuugagaucaaggacaagaagugcgacguccccugcaucggcaucgagauggugcacgauggcgggaaggagaccuggcacagcgccgccaccgccaucuacugccugaugggcuccgggcagcugcucugggacacggugaccggcgucgacauggcgcuguga

SEQ ID NO: 28975 - RNA, 1401 nt, Artificial Sequence
  derived and/or modified CDS sequence (AUadapt) from InfluenzaB__AEP20281__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccucgaacgugcaggccgugaaccgcuccaccaccaagggcgucacccuccugcugcccgagccggaguggacguacccccggcucagcugccccggguccaccuuucagaaggcccugcugaucagcccccaccgcuucggcgagaccaaggggaacuccgccccgcucaucauccgggagcccuucaucgcguguggccccaacgagugcaagcacuucgcccugacccacuacgccgcccagcccggcggguauuacaacggcacgcgcggggaccggaacaagcugcgccaccucaucagugugaagcugggcaagaucccgaccguggagaacuccaucuuccacauggcggccuggagcggguccgccugccacgauggcaaggaguggaccuacaucggcgucgacgggcccgacaacaacgcccugcucaagaucaaguauggcgaggccuacaccgacacguaccacucguacgcgaauaacauccugcggacccaggaguccgccugcaacugcaucgggggcaacuguuaccugaugaucaccgacggcagcgccagcgggguguccgagugccgcuuccucaagauccgggagggccgcaucaucaaggagaucuuucccaccgggcgggugaagcacacggaggagugcacgugcggcuucgccagcaauaagaccaucgagugcgccugccgcgacaacuccuacaccgcgaagcggcccuucgucaagcugaauguggagaccgacaccgccgagauccgccugaugugcaccgagaccuaccucgacacgccgcggcccgacgaugggagcaucaccggccccugcgaguccaacggcgacaaggggucgggcgggaucaagggcggguucgugcaucagcgcauggccuccaagaucggccggugguacagccgcaccauguccaagaccgagcggaugggcauggggcuguacgucaaguacgacggcgaucccugggccgacagcgacgcccuggcgcucuccggggugauggugagcauggaggagccgggcugguacuccuucggguuugagaucaaggacaagaagugcgacguccccugcaucggcaucgagauggugcacgauggcgggaaggagacguggcacagcgccgccaccgccaucuacugccugaugggcuccgggcagcugcucugggacaccgugaccggcgucgacauggcccuguga

SEQ ID NO: 28976 - RNA, 1401 nt, Artificial Sequence; identical to SEQ ID NO: 28748
  derived and/or modified CDS sequence (AUadapt) from InfluenzaB__AEP20292__NA

SEQ ID NO: 28977 - RNA, 1401 nt, Artificial Sequence; identical to SEQ ID NO: 28740
  derived and/or modified CDS sequence (AUadapt) from InfluenzaB__AEP20303__NA

SEQ ID NO: 28978 - RNA, 1401 nt, Artificial Sequence
  derived and/or modified CDS sequence (AUadapt) from InfluenzaB__AEP20314__NA
augcugcccaguaccauccagacccucacgcuguuccugaccuccggcggggugcuccugagccuguacgucuccgccagccucuccuaccugcuguauagcgacauccuccugaaguucucccagaccggcaucaccgccccgaucaugccccuggacugcgcgaacgccaguaacgugcaggccgugaaccgcuccgccacgaagggggucacccuccugcugcccgagcccgaguggaccuacccgcggcucagcugccccggcuccaccuuucagaaggcccugcugaucagcccccaccgcuucggggagacgaagggcaacuccgcgccccucaucauccgggagccguucaucgccugcggccccaaggaguguaagcacuucgcccugacccacuacgccgcgcagcccgggggcuacuacaaugggacccgcgaggaccggaacaagcugcgccaccucaucagcgugaagcugggcaagauccccaccguggagaacuccaucuuucacauggccgccuggagcggguccgccugccacgacggccgggaguggacguacaucggcgucgaugggccggacucgaacgcccugcucaagaucaaguacggcgaggcguacaccgauaccuaccacuccuacgccaagaacauccugcgcacccaggagagcgccugcaauugcaucgggggcgacugcuaccugaugaucacggacggccccgccagcgggaucuccgagugucgguuccucaagauccgcgagggccggaucaucaaggagaucuuccccaccgggcgcgugaagcacaccgaggagugcacgugcggcuuugccagcaacaagaccaucgagugcgcgugccgggacaacuccuauaccgccaagcgccccuucgugaagcugaacgucgagaccgacaccgccgagauccggcugaugugcacggagaccuaccucgauaccccgcgccccaacgacgggagcaucaccggccccugcgaguccaacggcgacaaggggaguggcgggaucaagggcggguucgugcaccagcggauggccuccaagaucggccgcugguacagccggacgauguccaagaccaagcgcaugggcauggggcuguacgugaaguacgauggcgaccccuggaccgacagcgaggcccuggcgcucuccggggucaugaucagcauggaggagccgggcugguacuccuuuggguucgagaucaaggacaagaagugcgacgugcccugcaucggcaucgagauggugcacgauggcgggaagaccacguggcacagcgccgccaccgccaucuacugccugaugggcuccgggcagcugcucugggacaccgucaccggcguggacauggcccuguga

SEQ ID NO: 28979 - RNA, 1401 nt, Artificial Sequence
  derived and/or modified CDS sequence (AUadapt) from InfluenzaB__AEP20336__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaacgaguguaagcacuucgcccugacccacuacgccgcgcagcccggcggguacuacaauggcacccgcggggaccggaacaagcugcgccaccucaucagcgugaagcugggcaagaucccgacgguggagaacuccaucuuccauauggccgccuggucgggguccgccugccacgacggcaaggaguggaccuacaucggcgucgacgggcccgauaacaacgcccugcucaagaucaaguacggcgaggcguacaccgacaccuaccauagcuacgccaacaacauccugcggacgcaggaguccgccugcaacuguaucgggggcaacugcuaccugaugaucaccgacggcagcgccagugggguguccgagugccgcuuccucaagauccgggagggccgcaucaucaaggagaucuuccccaccgggcgggugaagcacaccgaggagugcacgugcggcuuugccucgaacaagaccaucgagugcgcgugccgcgacaacuccuauaccgccaagcggcccuucgucaagcugaacguggagaccgacacggccgagauccgccugaugugcaccgagaccuaccucgacaccccgcggcccgaugacgggagcaucacgggccccugcgaguccaacggcgacaaggggagcggcgggaucaagggcggguuugugcaccagcgcauggccuccaagaucggccggugguacagccgcaccauguccaagaccgagcggaugggcauggggcuguacgucaaguacgacggcgaucccugggccgacucggacgcgcugacccucuccggggugauggugagcauggaggagccgggcugguacuccuucggguuugagaucaaggacaagaagugcgacguccccugcaucggcaucgagauggugcacgacggcgggaaggagacguggcauagcgccgccaccuccaucuacugccugaugggcagcgggcagcugcucugggacaccgugaccggcgucgacauggcccuguga

SEQ ID NO: 28980 - RNA, 1401 nt, Artificial Sequence
  derived and/or modified CDS sequence (AUadapt) from InfluenzaB__AEP20347__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaaugccucgaacgugcaggccgugaaccgcuccgccacgaagggcgucacccuccugcugcccgagcccgaguggaccuacccgcggcucagcugucccggguccaccuuccagaaggcccugcugaucagcccccaccgcuucggcgagacgaaggggaacuccgcgccccucaucauccgggagccguucaucgccuguggccccaccgagugcaagcacuucgcccugacccacuacgccgcgcagcccggcggguauuacaacggcacccgcgaggaccggaacaagcugcgccaccucaucagugugaagcuggggaagauccccacgguggagaacuccaucuuccacauggccgccuggagcggcuccgccugccaugacgggaaggaguggaccuacaucggcgucgacggcccggacucgaacgcccugcucaagaucaaguauggggaggcguacaccgacaccuaccacuccuacgccaagaauauccugcggacgcaggagagcgccugcaacugcaucggcggggacuguuaccugaugaucaccgacggccccgccagcggcaucuccgagugccgcuuccucaagauccgggaggggcgcaucaucaaggagaucuuucccaccggccgggugaagcacaccgaggagugcacgugcggguucgccagcaacaagaccaucgagugugcgugccgcgacaacuccuacaccgccaagcggcccuucgugaagcugaaugucgagaccgacacggccgagauccgccugaugugcaccgagaccuaccucgacaccccgcggcccaacgauggcagcaucacggggcccugcgaguccgacggcgacaagggcucggggggcaucaagggcggguuugugcaccagcgcauggccuccaagaucgggcggugguacagccgcaccauguccaagaccaagcggaugggcaugggccuguacgugaaguacgacggggaucccuggaccgacagcgaggcccuggcgcucuccggcgucauggugccgauggaggagcccgggugguacagcuucggcuuugagaucaaggacaagaagugcgacgugcccugcaucgggaucgagaugguccacgauggcggcaagacgaccuggcacuccgccgccaccgccaucuacugccugauggggagcggccagcugcucugggacaccgugacggggguggacauggcccuguga

SEQ ID NO: 28981 - RNA, 1401 nt, Artificial Sequence; identical to SEQ ID NO: 28980
  derived and/or modified CDS sequence (AUadapt) from InfluenzaB__AEP20358__NA

SEQ ID NO: 28982 - RNA, 1401 nt, Artificial Sequence; identical to SEQ ID NO: 28980
  derived and/or modified CDS sequence (AUadapt) from InfluenzaB__AEP20369__NA

SEQ ID NO: 28983 - RNA, 1401 nt, Artificial Sequence; identical to SEQ ID NO: 28980
  derived and/or modified CDS sequence (AUadapt) from InfluenzaB__AEP20380__NA

SEQ ID NO: 28984 - RNA, 1401 nt, Artificial Sequence
  derived and/or modified CDS sequence (AUadapt) from InfluenzaB__AEP20391__NA
augcugcccaguaccauccagacccucacgcuguuccugaccuccggcggggugcuccugagccuguacgucuccgccagccucuccuaucugcuguacagcgacauccuccugaaguucuccccgaccgagaucaccgcccccacgaugccccuggacugugcgaacgccagcaacgugcaggccgugaaccgcuccgccaccaagggcgucacccuccugcugcccgagccggaguggaccuacccccggcucaguugccccggguccacguuccagaaggcccugcugaucagcccccaccgcuucggcgagaccaaggggaauuccgcgccgcucaucauccgggagcccuucaucgccugcggccccaacgagugcaagcacuuugcccugacccacuacgccgcgcagcccggcggguacuacaacggcacccgcggggaucggaaccgccugcggcaccucaucagcgugaagcugggcaagaucccgacgguggagaacuccaucuuccauauggccgccuggagcggguccgccugccacgacggcaaggaguggaccuacaucggcgucgaugggcccgacaacaacgcccugcucaagaucaaguacggcgaggcguacaccgauaccuaccacagcuacgccaacaauauccugcgcacgcaggaguccgccugcaacugcaucgggggcaacugcuaucugaugaucaccgacggcagcgccagcgggguguccgagugccgguuccucaagauccgcgagggccggaucaucaaggagaucuuucccaccgggcgcgugaagcacaccgaggagugcacgugcggcuucgccagcaauaagaccaucgagugcgcgugccgggacaacuccuacaccgccaagcgccccuuugucaagcugaacguggagaccgacacggccgagauccggcugaugugcaccgacaccuaccucgauaccccgcgccccgacgacgggagcaucacgggccccugcgaguccaacggcgauaaggggagcggcgggaucaagggcggguucgugcaccagcggauggccuccaaggucggccgcugguacagccggaccauguccaagaccgagcgcaugggcauggggcuguaugugaaguacgacggcgaccccugggccgacagcgaugcgcuggccuucuccggggugauggucagcaugaaggagccgggcugguacuccuucggguucgagaucaaggauaagaagugcgacgugcccugcaucggcaucgagauggugcacgacggcgggaaggagaccuggcauagcgccgccacggccaucuacugccucaugggcuccgggcagcugcugugggacaccgucaccggcguggacauggcgcucuga

SEQ ID NO: 28985 - RNA, 1401 nt, Artificial Sequence
  derived and/or modified CDS sequence (AUadapt) from InfluenzaB__AEP20413__NA
augcugcccaguaccauccagacccucacgcuguuccugaccuccggcggggugcuccugagccuguacgucuccgcccuccugagcuaccugcucuacuccgacauccugcugaaguuuagcccgaccgagaucaucgcccccaccaugucccucgacugcgcgaacgccucgaacgugcaggccgugaaccgcuccgccacgaagggcgucaccuuucugcugcccgagcccgaguggaccuacccgcggcucagcugccccggguccaccuuccagaaggcccugcugaucagcccccaccgcuucggcgagacgaaggggaacuccgcgccccucaucauccgggagccguuuaucgccugcggccccaacgagugcaagcacuucgcccugacccacuacgccgcgcagcccggcggguauuacaacggcacccgcggggaccggaacaagcugcgccaccucaucagcgugaagcugggcaagauccccaccguggagaacuccaucuuucacauggccgccuggagcggguccgccugccacgacggcaaggaguggacguacaucggcgucgacgggccggacaaugacgcccugcucaaggugaaguacggcgaggcguacaccgacaccuaccacucguaugccaacaagauccugcggacccaggaguccgccugcaacugcaucgggggcaacugcuaccugaugaucacggauggcagcgccagcgggguguccgagugccgcuuccucaagauccgggagggccgcaucaucaaggagaucuuccccaccgggcgggucaagcacaccgaggagugcacgugcggcuuugccagcaacaagaccaucgagugcgcgugccgcgacaacuccuacaccgccaagcggcccuuugugaagcugaacguggagaccgacaccgccgagauccgccugaugugcacggacaccuaccucgacacgccccggccggacgaugggagcaucaccggccccugcgaguccaacggcgacaaggggucgggcgggaucaagggcggguucguccaccagcgcauggaguccaagaucggccggugguacagucgcaccauguccaagaccgagcggaugggcauggggcuguacgugaaguacaacggcgaccccugggccgacagcgacgcccuggcguuuuccggggugauggucagcaugaaggagcccggcugguacuccuucggguucgagaucaaggacaagaagugcgacgugccguguaucggcaucgagauggugcacgacggcgggaaggagaccuggcacagcgccgccaccgccaucuacugccucaugggcuccgggcagcugcugugggacacggucaccggcguggacauggcccucuga

SEQ ID NO: 28986 - RNA, 1401 nt, Artificial Sequence; identical to SEQ ID NO: 28985
  derived and/or modified CDS sequence (AUadapt) from InfluenzaB__AEP20435__NA

SEQ ID NO: 28987 - RNA, 1401 nt, Artificial Sequence; identical to SEQ ID NO: 28980
  derived and/or modified CDS sequence (AUadapt) from InfluenzaB__AEQ39031__NA

SEQ ID NO: 28988 - RNA, 1401 nt, Artificial Sequence
  derived and/or modified CDS sequence (AUadapt) from InfluenzaB__AEQ39275__NA
augcugcccaguaccauccagacccucacgcuguuccugaccuccggcggggugcuccugagccuguacgucuccgccagccucuccuaccugcuguacagugacauccuccugaaguucuccccgaaggagaucaccgcccccaccaugccccuggacugcgcgaacgccagcaacgugcaggccgugaaucacuccgccacgaagggcgucacccuccugcugcccgagccggaguggaccuacccccgccucagcugccccggguccaccuuccagaaggcccugcugaucucgccccaccgguuuggcgagacgaaggggaacuccgcgccgcucaucauccgcgagcccuucaucgccugcggccccaacgagugcaagcacuucgcccugacccauuacgccgcgcagcccggcggguacuacaacggcacccgcggggaccggaacaagcugcggcaccucaucagugugaagcugggcaagaucccgaccguggagaacuccaucuuccacauggccgccuggagcggguccgccugccacgauggcaaggaguggacguacaucggcgucgacgggcccgacaacaacgcccugcucaaggugaaguacggcgaggcguacaccgauaccuaccacucguacgccaacaagauccugcgcacccaggaguccgccugcaacuguaucgggggcaacugcuaccugaugaucacggacggcagcgccagcgggguguccgagugccgguuucucaagauccgcgagggccggaucaucaaggagaucuuccccaccgggcgcgucaagcacaccgaggagugcacgugcggcuucgccucgaacaagaccaucgagugugcgugccgggacaacuccuacaccgccaagcgccccuucgugaagcugaacguggagaccgauaccgccgagauccggcugaugugcacggacaccuaccucgacaccccgcgccccgacgacgggagcaucaccggccccugugaguccaacggcgacaaggggagcggcgggaucaagggcggguucguccaccagcggauggaguccaagaucggccgcugguacucgcggacgauguccaagaccgagcgcaugggcauggggcuguaugugaaguacgacggcgaccccugggccgacagcgacgcccuggcguucuccggggugauggucaguaugaaggagccgggcugguacuccuucggguucgagaucaaggacaagaagugcgacgugcccugcaucggcaucgagauggugcaugacggcgggaaggagaccuggcacagcgccgccaccgccaucuacugccucaugggcuccgggcagcugcugugggacacggucaccggcguggacauggcccucuga

SEQ ID NO: 28989 - RNA, 1401 nt, Artificial Sequence; identical to SEQ ID NO: 28988
  derived and/or modified CDS sequence (AUadapt) from InfluenzaB__AEQ39286__NA

SEQ ID NO: 28990 - RNA, 1401 nt, Artificial Sequence; identical to SEQ ID NO: 28988
  derived and/or modified CDS sequence (AUadapt) from InfluenzaB__AEQ39297__NA

SEQ ID NO: 28991 - RNA, 1401 nt, Artificial Sequence; identical to SEQ ID NO: 28988
  derived and/or modified CDS sequence (AUadapt) from InfluenzaB__AEQ39308__NA

SEQ ID NO: 28992 - RNA, 1401 nt, Artificial Sequence; identical to SEQ ID NO: 28988
  derived and/or modified CDS sequence (AUadapt) from InfluenzaB__AEQ39319__NA

SEQ ID NO: 28993 - RNA, 1401 nt, Artificial Sequence
  derived and/or modified CDS sequence (AUadapt) from InfluenzaB__AEQ39330__NA
augcugcccaguaccauccagacccucacgcuguuccugaccuccggcggggugcuccugagccuguacgucuccgccagccucuccuaccugcuguacagugacauccuccugaaguucuccccgaaggagaucaccgcccccaccaugccccuggacugcgcgaacgccagcaacgugcaggccgugaaucacuccgccacgaagggcgucacccuccugcugcccgagccggaguggaccuacccccgccucagcugccccggguccaccuuccagaaggcccugcugaucucgccccaccgguuuggcgagacgaaggggaacuccgcgccgcucaucauccgcgagcccuucaucgccugcggccccaacgagugcaagcacuucgcccugacccauuacgccgcgcagcccggcggguacuacaacggcacccgcggggaccggaacaagcugcggcaccucaucagugugaagcugggcaagaucccgaccguggagaacuccaucuuccacauggccgccuggagcggguccgccugccacgauggcaaggaguggacguacaucggcgucgacgggcccgacaacaacgcccugcucaaggugaaguacggcgaggcguacaccgauaccuaccacucguacgccaacaagauccugcgcacccaggaguccgccugcaacuguaucgggggcaacugcuaccugaugaucacggacggcagcgccagcgggguguccgagugccgguuucucaagauccgcgagggccggaucaucaaggagaucuuccccaccgggcgcgucaagcacaccgaggagugcacgugcggcuucgccucgaacaagaccaucgagugugcgugccgggacaacuccuacaccgccaagcgccccuucgugaagcugaacguggagaccgauaccgccgagauccggcugaugugcacggacaccuaccucgacaccccgcgccccgacgacgggagcaucaccggccccugugaguccaacggcgacaaggggagcggcgggaucaagggcggguucguccaccagcggauggaguccaagaucggccgcugguacucgcggacgauguccaagaccgagcgcaugggcauggggcuguaugugaaguacgacggcgaccccugggccgacagcgacgcccuggcguucuccggggugauggucaguaugaaggagccgggcugguacuccuucggguucgagaucaaggacaagaagugcgacgugcccugcaucggcaucgagauggugcaugacggcgggaaggagaccuggcacagcgccgccaccgccaucuacugccucaugggcuccgggcagcugcugugggacacggucaccggcguggacaucgcccucuga

SEQ ID NO: 28994 - RNA, 1401 nt, Artificial Sequence; identical to SEQ ID NO: 28988
  derived and/or modified CDS sequence (AUadapt) from InfluenzaB__AEQ39341__NA

SEQ ID NO: 28995 - RNA, 1401 nt, Artificial Sequence; identical to SEQ ID NO: 28988
  derived and/or modified CDS sequence (AUadapt) from InfluenzaB__AEQ39352__NA

SEQ ID NO: 28996 - RNA, 1401 nt, Artificial Sequence; identical to SEQ ID NO: 28988
  derived and/or modified CDS sequence (AUadapt) from InfluenzaB__AEQ39363__NA

SEQ ID NO: 28997 - RNA, 1401 nt, Artificial Sequence; identical to SEQ ID NO: 28954
  derived and/or modified CDS sequence (AUadapt) from InfluenzaB__AEQ39374__NA

SEQ ID NO: 28998 - RNA, 1401 nt, Artificial Sequence
  derived and/or modified CDS sequence (AUadapt) from InfluenzaB__AEQ39385__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccgcuccgccaccaagggcgucacccuccugcugcccgagccggaguggaccuacccccggcucagcugccccggguccacguuccagaaggcccugcugaucucgccccaucgcuucggcgagaccaaggggaacuccgcgccgcucaucauccgggagcccuucaucgccugcggccccaaggagugcaagcacuuugcccugacccacuacgccgcgcagcccggcggguacuacaacggcacccgcggggaccggaauaagcugcgccaccucaucagcgugaagcugggcaagaucccgacgguggagaacuccaucuuccacauggccgccuggagcggguccgccugccaugacggcaaggaguggaccuacaucggcgucgacgggcccgacagcaacgcccugcucaagaucaaguauggcgaggcguacaccgacaccuaccacuccuacgccaacaauauccugcggacgcaggagucggccugcaacugcaucgggggcaacugcuaucugaugaucaccgacggcagcgccuccgggaucagcgagugccgcuuccucaagauccgggagggccgcaucaucaaggagaucuuccccaccgggcgggugaagcauaccgaggagugcacgugcggcuucgccuccaacaagaccaucgagugcgcgugccgcgauaacucguacaccgccaagcggcccuucgugaagcugaacgucgagaccgacacggccgagauccgccugaugugcaccgagaccuaucucgacaccccgcggcccgacgacggguccaucacgggccccugcgagagcaacggcgauaagggguccggcgggaucaagggcggguucgugcaccagcgcaugaccagcaagaucggccggugguacucccgcaccaugucgaagaccaagcggaugggcauggggcuguacgugaaguaugacggcgaccccuggacggacuccgacgcccuggcccucagcggggucaugguguccauggaggagccgggcugguacaguuucggguucgagaucaaggacaagaagugcgacgugcccugcaucggcaucgagaugguccaugacggcgggaaggagaccuggcacuccgcggccaccgccaucuacugccugaugggcagcgggcagcugcucugggacaccgugacgggcguggacauggcccuguga

SEQ ID NO: 28999 - RNA, 1401 nt, Artificial Sequence
  derived and/or modified CDS sequence (AUadapt) from InfluenzaB__AEQ39444__NA
augcugcccaguaccauccagacccucacgcuguuccugaccuccggcggggugcuccugagccuguacgucuccgccagccucuccuaccugcuguacagugacauccuccugaaguucucccagaccgagaucaucgccccgaucaugccccuggacugcgcgaacgccucgaaugugcaggccgugaaccgcuccgccaccaagggcgucacgcuccugcugcccgagcccgaguggaccuacccgcggcucagcugccccggguccaccuuccagaaggcccugcugaucagcccccaucgcuucggcgagaccaaggggaacuccgcgccccucaucauccgggagccguucaucgccugcggccccacggagugcaagcacuuugcccugacccacuacgccgcgcagcccggcggguacuacaacggcacccgcgaggaccggaauaagcugcgccaccucaucagcgugaagcuggggaagauccccaccguggagaacuccaucuuccacauggccgccuggagcggcuccgccugucacgacgggaaggaguggacguacaucggcgucgacggcccggacucgaaugcccugcucaagaucaaguacggggaggcguacaccgacaccuaccacuccuacgccaagaauauccugcggacccaggagagcgccugcaacugcaucggcggggacugcuaucugaugaucacggacggccccgccagcggcaucuccgagugccgcuuccucaagauccgggaggggcgcaucaucaaggagaucuuccccaccggccgggugaagcacaccgaggaguguacgugcggguucgccagcaacaagaccaucgagugcgcgugccgcgauaacuccuacaccgccaagcggcccuucgugaagcugaacgucgagaccgacaccgccgagauccgccugaugugcacggagaccuaucucgacaccccgcggcccaacgacggcagcaucaccgggcccugcgaguccgacggcgauaagggcucggggggcaucaagggcggguucgugcaccagcgcauggccuccaagaucgggcggugguacagccgcacgauguccaagaccaagcggaugggcaugggccuguacgugaaguaugacggggaccccuggaccgacagcgaggcccuggcgcucuccggcgucauggugagcauggaggagccggggugguacuccuuuggcuucgagaucaaggacaagaagugcgacgugcccugcaucgggaucgagaugguccacgauggcggcaagaccacguggcacagcgccgccaccgccaucuacugccugaugggguccggccagcugcucugggacaccgugaccgggguggacauggcccuguga

SEQ ID NO: 29000 - RNA, 1401 nt, Artificial Sequence; identical to SEQ ID NO: 28901
  derived and/or modified CDS sequence (AUadapt) from InfluenzaB__AEQ39455__NA

SEQ ID NO: 29001 - RNA, 1401 nt, Artificial Sequence
  derived and/or modified CDS sequence (AUadapt) from InfluenzaB__AEQ39466__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuucagaaggcccugcugaucucgccccaccgcuucggcgagaccaaggggaacuccgcgccgcucaucauccgggagcccuucaucgccugcggccccaaugagugcaagcacuucgcccugacccacuacgccgcgcagcccggcggguauuacaacggcacccgcggggaccggaacaagcugcgccaccucaucagcgugaagcugggcaagaucccgacgguggagaauuccaucuuccacauggccgccuggagcggguccgccugccacgacggcaaggaguggaccuauaucggcgucgacgggcccgacaacaacgcccugcucaagaucaaguacggcgaggcguauaccgacaccuaccacagcuacgccaacaauauccugcggacgcaggaguccgccugcaacugcaucgggggcaacugcuaucugaugaucaccgacggcagcgccagcgggguguccgagugccgcuuccucaagauccgggagggccgcaucaucaaggagaucuuccccaccgggcgggugaagcauaccgaggagugcacgugcggcuucgccucgaacaagaccaucgagugugcgugccgcgacaacuccuacaccgccaagcggcccuucgucaagcugaacguggagaccgauacggccgagauccgccugaugugcaccgacaccuaccucgacaccccgcggcccgacgacgggaguaucacgggccccugcgaguccaacggcgacaaggggagcggcgggaucaagggcggguucgugcaucagcgcauggccuccaaggucggccggugguacagccgcaccauguccaagaccgagcggaugggcauggggcuguacgugaaguacgacggcgaccccugggccgauagcgacgcgcuggccuucuccggggugauggucagcaugaaggagccgggcugguacuccuuuggguucgagaucaaggacaagaagugcgacgugcccugcaucggcaucgagauggugcacgauggcgggaaggagaccuggcacagcgccgccacggccaucuacugccucaugggcuccgggcagcugcugugggacaccgucaccggcguggacauggcgcucuga

SEQ ID NO: 29002 - RNA, 1401 nt, Artificial Sequence; identical to SEQ ID NO: 28988
  derived and/or modified CDS sequence (AUadapt) from InfluenzaB__AEQ39477__NA

SEQ ID NO: 29003 - RNA, 1401 nt, Artificial Sequence
  derived and/or modified CDS sequence (AUadapt) from InfluenzaB__AEQ39488__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaacgaguguaagcacuucgcccugacccacuacgccgcgcagcccggcggguacuacaauggcacccgcggggaccggaacaagcugcgccaccucaucagcgugaagcugggcaagaucccgacgguggagaacuccaucuuccauauggccgccuggagcggguccgccugccacgacggcaaggaguggaccuacaucggcgucgacgggcccgauaacaacgcccugcucaaggugaaguacggcgaggcguacaccgacaccuaccauucguacgccaacaagauccugcggacgcaggaguccgccugcaacugcaucgggggcaauugcuaccugaugaucaccgacggcagcgccagcgggguguccgagugucgcuuccucaagauccgggagggccgcaucaucaaggagaucuuccccaccgggcgggucaagcacaccgaggagugcacgugcggcuucgccaguaacaagaccaucgagugcgcgugccgcgacaacuccuacaccgccaagcggcccuuugugaagcugaacguggagaccgacacggccgagauccgccugaugugcaccgacaccuaccucgacaccccgcggcccaaugacgggagcaucacgggccccugcgaguccaacggcgacaaggggucgggcgggaucaagggcggguuuguccaccagcgcauggagucccggaucggccgcugguacagccggaccauguccaagaccgagcgcaugggcauggggcuguacgugaaguacgacggcgaucccuggaccgacagcgacgcccuggccuucuccggggugauggucagcaugaaggagccgggcugguacuccuuuggguucgagaucaaggacaagaagugcgacgugcccugcaucggcaucgagauggugcacgauggcgggaaggagacguggcacagcgcggccaccgccaucuacugccucaugggcuccgggcagcugcugugggacaccgucaccggcguggacauggcccucuga

SEQ ID NO: 29004 - RNA, 1401 nt, Artificial Sequence; identical to SEQ ID NO: 28954
  derived and/or modified CDS sequence (AUadapt) from InfluenzaB__AEQ39499__NA

SEQ ID NO: 29005 - RNA, 1401 nt, Artificial Sequence; identical to SEQ ID NO: 28800
  derived and/or modified CDS sequence (AUadapt) from InfluenzaB__AEQ39510__NA

SEQ ID NO: 29006 - RNA, 1401 nt, Artificial Sequence
  derived and/or modified CDS sequence (AUadapt) from InfluenzaB__AEQ49685__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccgcuccgccaccaagggcgucacccuccugcugcccgagccggaguggaccuacccccggcucagcugccccggguccacguuccagaaggcccugcugaucagcccccaccgcuuuggcgagaccaaggggaacuccgcgccgcucaucauccgggagcccuucaucgccugcggccccaacgagugcaagcacuuugcccugacccacuacgccgcgcagcccggcggguacuacaacggcacccgcggggaccggaauaagcugcgccaccucaucucggugaagcugggcaagaucccgacgguggagaacuccaucuuccacauggccgccuggagcggguccgccugccaugacggcaaggaguggaccuacaucggcgucgacgggcccgacaacaacgcccugcucaaggugaaguauggcgaggcguacaccgacaccuaccacagcuacgccaauaagauccugcggacgcaggaguccgccugcaacugcaucgggggcaacugcuaccugaugaucaccgacggcagugccucggggguguccgagugccgcuuccucaagauccgggagggccgcaucaucaaggagaucuuccccaccgggcgggucaagcacaccgaggagugcacguguggcuucgccagcaacaagaccaucgagugcgcgugccgcgacaauuccuacaccgccaagcggcccuucgugaagcugaacguggagaccgacacggccgagauccgccugaugugcaccgacaccuaccucgauaccccgcggcccaacgacgggagcaucacgggccccugcgaguccgacggcgacaaggggaguggcgggaucaagggcggguucguccaccagcgcauggaguccaagaucggccggugguacucgcgcaccauguccaagaccgagcggaugggcauggggcuguacgugaaguacgauggcgaccccugggccgacagcgacgcccuggcguucuccggggugauggucagcaugaaggagccgggcugguacuccuuuggguucgagaucaaggacaagaagugcgacgugcccugcaucggcaucgagauggugcacgauggcgggaaggagaccuggcacagcgccgccacggccaucuacugccucaugggcuccgggcagcugcugugggacaccgucaccggcguggacauggaccucuga

SEQ ID NO: 29007 - RNA, 1401 nt, Artificial Sequence
  derived and/or modified CDS sequence (AUadapt) from InfluenzaB__AEQ49686__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuucagaaggcccugcugaucucgccccaccgcuucggcgagaccaaggggaacuccgcgccgcucaucauccgggagcccuucaucgccugcggccccaaugagugcaagcacuucgcccugacccacuacgccgcgcagcccggcggguauuacaacggcacccgcggggaccggaacaagcugcgccaccucaucagcgugaagcugggcaagaucccgacgguggagaauuccaucuuccacauggccgccuggagcggguccgccugccacgauggcaaggaguggaccuacaucggcgucgacgggcccgacaacgacgcccugcucaaggugaaguacggcgaggcguauaccgacaccuaccacagcuacgccaauaagauccugcggacgcaggaguccgccugcaacugcaucgggggcaacugcuaccugaugaucaccgauggcagcgccagcgggguguccgagugccgcuuccucaagauccgggagggccgcaucaucaaggagaucuuccccaccgggcgggucaagcauaccgaggagugcacgugcggcuucgccucgaacaagaccaucgagugcgcgugucgcgacaacuccuacaccgccaagcggcccuucgugaagcugaacguggagaccgauacggccgagauccgccugaugugcaccgacaccuaccucgacaccccgcggcccgacgacgggaguaucacgggccccugcgaguccaacggcgacaaggggagcggcgggaucaagggcggguucguccaucagcgcauggaguccaagaucggccggugguacagccgcaccauguccaagaccgagcggaugggcauggggcuguacgugaaguacgacggcgaccccugggccgauagcgacgcccuggcguucuccggggugauggucagcaugaaggagccgggcugguacuccuuuggguucgagaucaaggacaagaagugcgacgugcccugcaucggcaucgagauggugcacgauggcgggaaggagaccuggcacagcgccgccacggccaucuacugccucaugggcuccgggcagcugcugugggacaccgucaccggcguggacauggcccucuga

SEQ ID NO: 29008 - RNA, 1401 nt, Artificial Sequence; identical to SEQ ID NO: 28662
  derived and/or modified CDS sequence (AUadapt) from InfluenzaB__AEQ49687__NA

SEQ ID NO: 29009 - RNA, 1401 nt, Artificial Sequence
  derived and/or modified CDS sequence (AUadapt) from InfluenzaB__AEQ49688__NA
augcugcccaguaccauccagacccucacgcuguuccugaccuccggcggggugcuccugagccuguacgucuccgccagccucuccuaccugcuguauagcgacauccuccugaaguucucccgcaccgagaucaccgccccgaucaugccccugggcugcgcgaacgccucgaaugugcaggccgugaaccgguccgccacgaagggggucacccuccugcugcccgagcccgaguggaccuacccgcgccucagcugccccggcuccaccuuccagaaggcccugcugaucaguccccaccgguucggggagacgaagggcaacuccgcgccccucaucauccgcgagccguucaucgccugcggccccaaggagugcaagcauuucgcccugacccacuacgccgcgcagcccgggggcuacuacaaugggacccgggaggaccgcaacaagcugcggcaccucaucagcgugaagcugggcaagauccccaccguggagaacuccaucuuccauauggccgccuggagcggguccgccugccacgacggccgcgaguggacguacaucggcgucgaugggccggacucgaacgcccugcucaagaucaaguacggcgaggcguacaccgacaccuaucacuccuacgccaagaacauccugcggacccaggagagcgccugcaacuguaucgggggcgacugcuaccugaugaucacggacggccccgccagcgggaucuccgagugucgcuuccucaagauccgggagggccgcaucaucaaggagaucuuccccaccgggcgggugaagcacaccgaggagugcacgugcggcuucgccaguaacaagaccaucgagugcgcgugccgcgacaacuccuauaccgccaagcggcccuucgugaagcugaacgucgagaccgacaccgccgagauccgccugaugugcacggagaccuaccucgacaccccgcggcccaaugacgggagcaucaccggccccugcgaguccaacggcgacaaggggaguggcgggaucaagggcggguucgugcaccagcgcauggccuccaagaucggccggugguacagccgcacgauguccaagaccaagcggaugggcauggggcuguacgugaaguacgauggcgaccccuggaccgacagcgaggcccuggcgcucuccggggucauggugagcauggaggagccgggcugguacuccuuuggguucgagaucaaggacaagaagugcgacgugcccugcaucggcaucgagaugguccacgauggcgggaagaccacguggcacagcgccgccaccgccaucuacugccugaugggcuccgggcagcugcucugggacaccgugaccggcgugaacaugacgcuguga

SEQ ID NO: 29010 - RNA, 1401 nt, Artificial Sequence
  derived and/or modified CDS sequence (AUadapt) from InfluenzaB__AEQ49691__NA
augcugcccaguaccauccagacccucacgcuguuccugaccuccggcggggugcuccugagccuguacgucuccgcccuccugagcuaccugcucuauuccgacauccugcugaaguucagcccgaccgagaucaccgcccccacgaugucccucgacugcgcgaacgccaguaacgugcaggccgugaaccgcuccgccaccaagggcgucaccuuccugcugcccgagcccgaguggaccuacccgcggcucagcugucccggguccacguuccagaaggcccugcugaucagcccccaccgcuucggcgagaccaaggggaacuccgcgccccucaucauccgggagccguucaucgccuguggccccaacgagugcaagcacuucgcccugacccacuaugccgcgcagcccggcggguacuacaacggcacccgcggggaccggaacaagcugcgccaccucaucagugugaagcugggcaagauccccacgguggagaacuccaucuuccacauggccgccuggagcggguccgccugccacgauggcaaggaguggaccuacaucggcgucgacgggccggacaacgacgcccugcucaaggugaaguauggcgaggcguacaccgacaccuaccacagcuacgccaauaagauccugcggacgcaggaguccgccugcaacugcaucgggggcaacugcuaucugaugaucaccgacggcagcgccagcgggguguccgagugccgcuuccucaagauccgggagggccgcaucaucaaggagaucuuccccaccgggcgggucaagcauaccgaggagugcacgugcggcuucgccagcaacaagaccaucgagugugcgugccgcgacaacuccuacaccgccaagcggcccuucgugaagcugaacguggagaccgauacggccgagauccgccugaugugcaccgacaccuaccucgacacgccccggccggacgacgggaguaucaccggccccugcgaguccaacggcgaccgcgggagcggcgggaucaagggcggguucguccaucagcggauggaguccaagaucggccgcugguacagccggaccauguccaagaccgagcgcaugggcauggggcuguacgugaaguacgacggcgaccccugggccgauagcgacgcccuggcguucuccggggugauggucagcaugaaggagcccggcugguacuccuuuggguucgagaucaaggacaagaagugcgacgugccgugcaucggcaucgagauggugcacgauggcgggaaggagaccuggcacagcgccgccacggccaucuacugccucaugggcuccgggcagcugcugugggacaccgucaccggcguggacauggcccucuga

SEQ ID NO: 29011 - RNA, 1401 nt, Artificial Sequence
  derived and/or modified CDS sequence (AUadapt) from InfluenzaB__AEQ49692__NA
augcugcccaguaccauccagacccucacgcuguuccugaccuccggcggggugcuccugagccuguacgucuccgccagccucuccuaccugcuguacagugacauccuccugaaguucuccccgaccgagaccacggcccccaccaugagccuggacugcgcgaacgccuccaaugugcaggccgugaaccgcucggccaccaagggcgucaccuuccuccugcccgagcccgaguggacguacccgcggcuguccugccccgggagcaccuuucagaaggcccuccugaucagcccccaccgcuucggcgagaccaaggggaacuccgcgccccugaucauccgggagccguucaucgccugcggccccaaugagugcaagcacuucgcccucacccacuacgccgcgcagcccggcggguacuauaacggcacgcgcggggaccggaacaagcugcgccaccugaucuccgugaagcucggcaagauccccaccguggagaacagcaucuuucacauggccgccugguccgggagcgccugccacgacggcaaggaguggaccuacaucggcgucgaugggccggacaacgacgcccugcugaaggugaaguacggcgaggcguacaccgacacguaucacuccuacgccaacaagauccuccggacccaggagucggccugcaacuguaucgggggcaacugcuaccugaugaucaccgacggcagcgccuccggggugagcgagugucgcuuccugaagauccgggagggccgcaucaucaaggagaucuuccccaccgggcgggucaagcacacggaggagugcacgugcggcuucgccuccaauaagaccaucgagugcgcgugccgcgacaacagcuacaccgccaagcggcccuuugugaagcucaacguggagaccgacaccgccgagauccgccugaugugcaccgacaccuaccuggacacgccccggccggaugacggguccaucaccggccccugcgagagcaacggcgacaagggguccggcgggaucaagggcggguucguccaucagcgcauggagucgaagaucggccggugguacucccgcaccaugagcaagaccgagcggaugggcauggggcucuacgugaaguacgacggcgaucccugggccgacuccgacgcccuggcguucagcggggugauggucuccaugaaggagcccggcugguacagcuuuggguucgagaucaaggacaagaagugcgacgugccgugcaucggcaucgagauggugcacgauggcgggaaggagacguggcacuccgccgccaccgccaucuacugccugaugggcagcgggcagcuccugugggacaccgucaccggcguggacauggcccuguga

SEQ ID NO: 29012 - RNA, 1401 nt, Artificial Sequence
  derived and/or modified CDS sequence (AUadapt) from InfluenzaB__AEQ49693__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccagcaacgugcaggccgugaaccgcuccgccaccaagggcgucacccuccugcugcccgagccggaguggaccuacccccggcucagcugucccggguccacguuccagaaggcccugcugaucagcccccaccgcuucggcgagaccaaggggaacuccgcgccgcucaucauccgggagcccuuuaucgccugcggccccaacgagugcaagcacuucgcccugacccacuaugccgcgcagcccggcggguacuacaacggcacccgcggggaccggaacaagcugcgccaucucaucagcgugaagcugggcaagaucccgacgguggagaacuccaucuuccacauggccgccuggagcggguccgccugucacgacggcaaggaguggaccuacaucggcgucgacgggcccgacaauaacgcccugcucaaggugaaguacggcgaggcguacaccgacaccuaccauucguacgccaacaagauccugcggacgcaggaguccgccugcaacugcaucgggggcaauugcuaccugaugaucaccgacggcagcgccagcgggguguccgagugucgcuuccucaagauccgggagggccgcaucaucaaggagaucuuccccaccgggcgggucaagcacaccgaggagugcacgugcggcuuugccagcaaccgcaccaucgagugcgcgugccgggacaauuccuacaccgccaagcgccccuucgugaagcugaacguggagaccgacacggccgagauccggcugaugugcaccgauaccuaccucgacaccccgcgccccaacgacgggagcaucacgggccccugcgaguccgauggcgacaaggggagcggcgggaucaagggcggguucguccaccagcggauggaguccaagaucggccgcugguacagucggaccauguccaagaccgagcgcaugggcauggggcuguacgugaaguacgacggcgaccccugggccgacagugacgcccuggcguucuccggggugauggucagcaugaaggagccgggcugguacuccuucggguuugagaucaaggacaagaagugcgacgugcccugcaucggcaucgagauggugcacgauggcgggaaggagaccuggcacagcgccgccacggccaucuacugccucaugggcuccgggcagcugcugugggacaccgucaccggcguggacauggcccucuga

SEQ ID NO: 29013 - RNA, 1401 nt, Artificial Sequence
  derived and/or modified CDS sequence (AUadapt) from InfluenzaB__AEQ49695__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaacgaguguaagcacuucgcccugacccacuacgccgcgcagcccggcggguacuacaauggcacccgcggggaccggaacaagcugcgccaccucaucagcgugaagcugggcaagaucccgacgguggagaacuccaucuuccauauggccgccuggagcggguccgccugccacgacggcaaggaguggaccuacaucggcgucgacgggcccgauaacaacgcccugcucaaggugaaguacggcgaggcguacaccgacaccuaccauucguacgccaacaagauccugcggacgcaggaguccgccugcaacugcaucgggggcaauugcuaccugaugaucaccgacggcagcgccagcgggguguccgagugucgcuuccucaagauccgggagggccgcaucaucaaggagaucuuccccaccgggcgggucaagcacaccgaggagugcacgugcggcuucgccaguaacaagaccaucgagugcgcgugccgcgacaacuccuacaccgccaagcggcccuuugugaagcugaacguggagaccgacacggccgagauccgccugaugugcaccgacaccuaccucgacaccccgcggcccaaugacgggagcaucacgggccccugcgaguccgacggcgacaaggggucgggcgggaucaagggcggguuuguccaccagcgcauggaguccaagaucggccggugguacagccgcaccauguccaagaccgagcggaugggcauggggcuguacgugaaguacgacggcgaucccugggccgacagcgacgcccuggcguucuccggggugauggucagcaugaaggagccgggcugguacuccuuuggguucgagaucaaggacaagaagugcgacgugcccugcaucggcaucgagauggugcacgauggcgggaaggagaccuggcacagcgccgccacggccaucuacugccucaugggcuccgggcagcugcugugggacaccgucaccggcguggacauggcccucuga

SEQ ID NO: 29014 - RNA, 1401 nt, Artificial Sequence
  derived and/or modified CDS sequence (AUadapt) from InfluenzaB__AEQ49697__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugagccuggacugcgcgaacgccuccaaugugcaggccgugaaccgcucggccaccaagggcgucaccuuccuccugcccgagcccgaguggaccuacccgcggcuguccugccccgggagcacguuccagaaggcccuccugaucaguccccaccgcuucggcgagaccaaggggaacuccgcgccccugaucauccgggagccguucaucgccugcggccccaacgaguguaagcacuucgcccucacccacuacgccgcgcagcccggcggguacuacaacggcacccgcggggaucggaacaagcugcgccaccugaucuccgugaagcucggcaagauccccacgguggagaacagcaucuuccacauggccgccugguccgggagugccugccacgacggcaaggaguggaccuacaucggcgucgacgggccggacaaugacgcccugcugaaggugaaguacggcgaggcguacaccgacaccuaccacuccuacgccaauaagauccuccggacgcaggagucggccugcaacugcaucgggggcaacugcuaucugaugaucaccgacggcagcgccuccggggugagcgagugccgcuuccugaagauccgggagggccgcaucaucaaggagaucuuccccaccgggcgggucaagcacaccgaggaguguacgugcggcuucgccuccaacaagaccaucgagugcgcgugccgcgacaauagcuacaccgccaagcggcccuucgugaagcucaacguggagaccgacacggccgagauccgccugaugugcaccgauaccuaccuggacacgccccggccggacgacggguccaucaccggccccugcgagagcaacggcgauaagggguccggcgggaucaagggcggguucguccaccagcgcauggagucgaagaucggccggugguacucccgcaccaugagcaagaccgagcggaugggcauggggcucuacgugaaguaugacggcgaccccugggccgacuccgacgcccuggcguucagcggggugauggucuccaugaaggagcccggcugguacaguuucggguucgagaucaaggacaagaagugcgacgugccgugcaucggcaucgagauggugcaugacggcgggaaggagaccuggcacuccgccgccacggccaucuacugccugaugggcagcgggcagcuccugugggacaccgucaccggcguggacauggcccuguga

SEQ ID NO: 29015 - RNA, 1401 nt, Artificial Sequence; identical to SEQ ID NO: 29014
  derived and/or modified CDS sequence (AUadapt) from InfluenzaB__AEQ49698__NA

SEQ ID NO: 29016 - RNA, 1401 nt, Artificial Sequence; identical to SEQ ID NO: 29014
  derived and/or modified CDS sequence (AUadapt) from InfluenzaB__AEQ49699__NA

SEQ ID NO: 29017 - RNA, 1401 nt, Artificial Sequence; identical to SEQ ID NO: 29014
  derived and/or modified CDS sequence (AUadapt) from InfluenzaB__AEQ49700__NA

SEQ ID NO: 29018 - RNA, 1401 nt, Artificial Sequence; identical to SEQ ID NO: 29011
  derived and/or modified CDS sequence (AUadapt) from InfluenzaB__AEQ49701__NA

SEQ ID NO: 29019 - RNA, 1401 nt, Artificial Sequence; identical to SEQ ID NO: 29014
  derived and/or modified CDS sequence (AUadapt) from InfluenzaB__AEQ49702__NA

SEQ ID NO: 29020 - RNA, 1401 nt, Artificial Sequence; identical to SEQ ID NO: 29011
  derived and/or modified CDS sequence (AUadapt) from InfluenzaB__AEQ49703__NA

SEQ ID NO: 29021 - RNA, 1401 nt, Artificial Sequence; identical to SEQ ID NO: 29014
  derived and/or modified CDS sequence (AUadapt) from InfluenzaB__AEQ49705__NA

SEQ ID NO: 29022 - RNA, 1401 nt, Artificial Sequence
  derived and/or modified CDS sequence (AUadapt) from InfluenzaB__AEQ49706__NA
augcugcccaguaccauccagaugcucacccuguuccugacgcucggcggggugcugcugucccucuacgucagcgccucccugagcuaccugcucuaccuggauauccugcucaaguucccgcccaccgagaucaccgcccccaccaugccccuggacugcgcgaacgccuccaacgugcaggccgugaaccgcagcgccacgaagggcgucaccuuucugcucccggagcccgaguggaccuacccccggcuguccugccccgggagcaccuuccagaaggcccugcucaucuccccgcaccgcuucggcgagacgaaggggaacagugcgccccugaucauccgggagcccuucaucgccugcggccccaaggagugcaagcacuucgcccugacccacuacgccgcgcagccgggcggguauuacaacggcacccgcggggaccggaacaagcuccgccaccugaucuccgugaagcugggcaagauccccaccguggagaacaguaucuuccacauggccgccugguccgggagcgccugccacgacggcaaggaguggacguacaucggcgucgaugggcccgacaacaacgcccuccugaagaucaaguacggcgaggcguucaccgacaccuaccauuccuacgccaacaacauccugcggacccaggagagcgccugcaacugcaucgggggcaauugcuaccucaugaucacggacggcuccgccagcgggguguccgagugccgcuuccugaagauccgggagggccgcaucaucaaggagaucuuucccaccgggcgggugaagcacaccgaggagugcacgugcggcuucgccagcaacaagaccaucgagugcgcgugucgcgacaacagcuacaccgccaagcggccguucgucaagcugaacguggagaccgacaccgccgagauccgccucauguguacggacaccuaccuggacacgccccggcccgacgacggguccaucaccggccccugcgagucgaauggcgacaagggguccggcgggaucaagggcggguucgugcaccagcgcauggccagcaagaucggccggugguacucccgcaccaugagcaagaccgagcggaugggcauggggcuguaugucaaguacgacggcgacccgugggccgacuccgacgcgcucgccuucagcggggugaugguguccaugaaggagcccggcugguauagcuucggguucgagaucaaggacaagaagugcgacguccccugcaucggcaucgagauggugcaugacggcgggaaggagaccuggcacuccgccgccaccgccaucuacugccugaugggcagcgggcagcugcucugggacacggugaccggcgucaacauggcgcuguga

SEQ ID NO: 29023 - RNA, 1401 nt, Artificial Sequence; identical to SEQ ID NO: 29014
  derived and/or modified CDS sequence (AUadapt) from InfluenzaB__AEQ49707__NA

SEQ ID NO: 29024 - RNA, 1401 nt, Artificial Sequence; identical to SEQ ID NO: 29014
  derived and/or modified CDS sequence (AUadapt) from InfluenzaB__AEQ49708__NA

SEQ ID NO: 29025 - RNA, 1401 nt, Artificial Sequence
  derived and/or modified CDS sequence (AUadapt) from InfluenzaB__AEQ49709__NA
augcugcccaguaccauccagacccucacgcuguuccugaccuccggcggggugcuccugagccuguacgucuccgcccuccugagcuaccugcucuacuccgauauccugcugaaguucagcccgaccgagaucaccgcccccacgaugucccucgacugcgcgaacgccagcaaugugcaggccgugaaccgcuccgccaccaagggcgucaccuuccugcugcccgagcccgaguggaccuacccgcggcucagcugccccggguccacguuccagaaggcccugcugaucucgccccaucgcuucggcgagaccaaggggaacuccgcgccccucaucauccgggagccguucaucgccugcggccccaacgagugcaagcauuucgcccugacccacuacgccgcgcagcccggcggguacuacaacggcacccgcggggaccggaauaagcugcgccaccucaucagcgugaagcugggcaagauccccacgguggagaacuccaucuuccacauggccgccuggagcggguccgccugucacgacggcaaggaguggaccuacaucggcgucgacgggccggacaacgaugcccugcucaaggugaaguacggcgaggcguacaccgacaccuaccacagcuacgccaauaagauccugcggacgcaggaguccgccugcaacugcaucgggggcaacugcuaccugaugaucaccgauggcagcgccagcgggguguccgagugccgcuuccucaagauccgggagggccgcaucaucaaggagaucuuccccaccgggcgggucaagcacaccgaggagugcacguguggcuucgccucgaacaagaccaucgagugcgcgugccgcgacaauuccuacaccgccaagcggcccuucgugaagcugaacguggagaccgacacggccgagauccgccugaugugcaccgacaccuaucucgacacgccccggccggacgacgggagcaucaccggccccugcgaguccaacggcgacaaggggaguggcgggaucaagggcggguucguccaccagcgcauggaguccaagaucggccggugguacagccgcaccauguccaagaccgagcggaugggcauggggcuguacgugaaguacgauggcgaccccugggccgacagcgacgcccuggcguucuccggggugauggucagcaugaaggagcccggcugguacuccuuuggguucgagaucaaggacaagaagugcgacgugccgugcaucggcaucgagauggugcacgauggcgggaaggagaccuggcacagcgccgccacggccaucuacugccucaugggcuccgggcaccuccugugggacaccgucaccggcguggacauggcccuguga

SEQ ID NO: 29026 - RNA, 1401 nt, Artificial Sequence; identical to SEQ ID NO: 28988
  derived and/or modified CDS sequence (AUadapt) from InfluenzaB__AEQ49710__NA

SEQ ID NO: 29027 - RNA, 1401 nt, Artificial Sequence; identical to SEQ ID NO: 28985
  derived and/or modified CDS sequence (AUadapt) from InfluenzaB__AER27042__NA

SEQ ID NO: 29028 - RNA, 1401 nt, Artificial Sequence; identical to SEQ ID NO: 29013
  derived and/or modified CDS sequence (AUadapt) from InfluenzaB__AER27053__NA

SEQ ID NO: 29029 - RNA, 1401 nt, Artificial Sequence; identical to SEQ ID NO: 28985
  derived and/or modified CDS sequence (AUadapt) from InfluenzaB__AER27064__NA

SEQ ID NO: 29030 - RNA, 1401 nt, Artificial Sequence; identical to SEQ ID NO: 28988
  derived and/or modified CDS sequence (AUadapt) from InfluenzaB__AET43128__NA

SEQ ID NO: 29031 - RNA, 1401 nt, Artificial Sequence; identical to SEQ ID NO: 28988
  derived and/or modified CDS sequence (AUadapt) from InfluenzaB__AET43139__NA

SEQ ID NO: 29032 - RNA, 1401 nt, Artificial Sequence
  derived and/or modified CDS sequence (AUadapt) from InfluenzaB__AET43150__NA
augcugcccaguaccauccagacccucacgcuguuccugaccuccggcggggugcuccugagccuguacgucuccgccucgcucuccuaccugcuguacagcgauauccuccugaaguucuccccgaaggagaucaccgcccccaccaugccccuggacugcgcgaacgccagcaacgugcaggccgugaaccauuccgccacgaagggcgucacccuccugcugcccgagccggaguggaccuacccccgccucucgugccccggguccaccuuccagaaggcccugcugaucagcccccaccgguucggcgagacgaaggggaacuccgcgccgcucaucauccgcgagcccuuuaucgccugcggccccaacgagugcaagcacuucgcccugacccacuacgccgcgcagcccggcggguauuacaacggcacccgcggggaccggaacaagcugcggcaccucaucagcgugaagcugggcaagaucccgaccguggagaacuccaucuuucacauggccgccuggucgggguccgccugccacgacggcaaggaguggacguacaucggcgucgacgggcccgacaauaacgcccugcucaaggugaaguacggcgaggcguacaccgacaccuaccacagcuaugccaacaagauccugcgcacccaggaguccgccugcaacugcaucgggggcaacugcuaccugaugaucacggauggcucggccagcgggguguccgagugccgguuccucaagauccgcgagggccggaucaucaaggagaucuuccccaccgggcgcgucaagcacaccgaggagugcacgugcggcuuugccagcaacaagaccaucgagugcgcgugccgggacaacuccuacaccgccaagcgccccuuugugaagcugaacguggagaccgacaccgccgagauccggcugaugugcacggacaccuaccucgacaccccgcgccccgacgaugggucgaucaccggccccugcgaguccaacggcgacaaggggagcggcgggaucaagggcggguucguccaccagcggauggaguccaagaucggccgcugguacagucggacgauguccaagaccgagcgcaugggcauggggcuguacgugaaguacgacggcgaccccugggccgacucggacgcccugaccuuuuccggggugauggucagcaugaaggagccgggcugguacuccuucggguucgagaucaaggacaagaagugcgacgugcccuguaucggcaucgagauggugcacgacggcgggaaggagaccuggcacagcgcggccacggccaucuacugccucaugggcuccgggcagcugcugugggacaccgucaccggcguggacauggcccucuga

SEQ ID NO: 29033 - RNA, 1401 nt, Artificial Sequence; identical to SEQ ID NO: 28988
  derived and/or modified CDS sequence (AUadapt) from InfluenzaB__AET43161__NA

SEQ ID NO: 29034 - RNA, 1401 nt, Artificial Sequence; identical to SEQ ID NO: 28988
  derived and/or modified CDS sequence (AUadapt) from InfluenzaB__AET43172__NA

SEQ ID NO: 29035 - RNA, 1401 nt, Artificial Sequence; identical to SEQ ID NO: 28988
  derived and/or modified CDS sequence (AUadapt) from InfluenzaB__AET43183__NA

SEQ ID NO: 29036 - RNA, 1401 nt, Artificial Sequence; identical to SEQ ID NO: 28988
  derived and/or modified CDS sequence (AUadapt) from InfluenzaB__AET43194__NA

SEQ ID NO: 29037 - RNA, 1401 nt, Artificial Sequence; identical to SEQ ID NO: 28988
  derived and/or modified CDS sequence (AUadapt) from InfluenzaB__AET43216__NA

SEQ ID NO: 29038 - RNA, 1401 nt, Artificial Sequence; identical to SEQ ID NO: 28988
  derived and/or modified CDS sequence (AUadapt) from InfluenzaB__AET43227__NA

SEQ ID NO: 29039 - RNA, 1401 nt, Artificial Sequence
  derived and/or modified CDS sequence (AUadapt) from InfluenzaB__AET50947__NA
augcugcccaguaccauccagacccucacgcuguuccugaccuccggcggggugcuccugagccuguacgucuccgccucgcucuccuaccugcuguacagcgauauccuccugaaguucuccccgaaggagaucaccgcccccaccaugccccuggacugcgcgaacgccagcaacgugcaggccgugaaccauuccgccacgaagggcgucacccuccugcugcccgagccggaguggaccuacccccgccucucgugccccggguccaccuuccagaaggcccugcugaucagcccccaccgguucggcgagacgaaggggaacuccgcgccgcucaucauccgcgagcccuuuaucgccugcggccccaacgagugcaagcacuucgcccugacccacuacgccgcgcagcccggcggguauuacaacggcacccgcggggaccggaacaagcugcggcaccucaucagcgugaagcugggcaagaucccgaccguggagaacuccaucuuucacauggccgccuggucgggguccgccugccacgacggcaaggaguggacguacaucggcgucgacgggcccgacaauaacgcccugcucaaggugaaguacggcgaggcguacaccgacaccuaccacagcuaugccaacaagauccugcgcacccaggaguccgccugcaacugcaucgggggcaacugcuaccugaugaucacggauggcucggccagcgggguguccgagugccgguuccucaagauccgcgagggccggaucaucaaggagaucuuccccaccgggcgcgucaagcacaccgaggagugcacgugcggcuuugccagcaacaagaccaucgagugcgcgugccgggacaacuccuacaccgccaagcgccccuuugugaagcugaacguggagaccgacaccgccgagauccggcugaugugcacggacaccuaccucgacaccccgcgccccgacgaugggucgaucaccggccccugcgaguccaacggcgacaaggggagcggcgggaucaagggcggguucguccaccagcggauggaguccaagaucggccgcugguacagucggacgauguccaagaccgagcgcaugggcauggggcuguacgugaaguacgacggcgaccccugggccgacucggacgcccuggcguuuuccggggugaugaucagcaugaaggagccgggcugguacuccuucggguucgagaucaaggacaagaagugcgacguccccuguaucggcaucgagauggugcacgacggcgggaaggagaccuggcacagcgccgccaccgccaucuacugccucaugggcuccgggcagcugcugugggacacggugaccggcgucgacauggcccucuga

SEQ ID NO: 29040 - RNA, 1401 nt, Artificial Sequence
  derived and/or modified CDS sequence (AUadapt) from InfluenzaB__AET50958__NA
augcugcccaguaccauccagacccucacgcuguuccugaccuccggcggggugcuccugagccuguacgucuccgccagccucuccuaccugcuguacucggauauccuccugaaguucuccccgaaggagaucaccgcccccaccaugccccuggacugcgcgaacgccagcaacgugcaggccgugaaccauuccgccacgaagggcgucacccuccugcugcccgagcucgaguggaccuacccgcgccugagcugccccggguccaccuuccagaaggcccugcucaucucgccccaccgguucggcgagacgaaggggaacuccgcgccccugaucauccgcgagccguuuaucgccugcggccccaacgagugcaagcacuucgcccugacccacuacgccgcgcagcccggcggguauuacaacggcacccgcggggaccggaacaagcuccggcaccugaucagcgugaagcugggcaagauccccaccguggagaacuccaucuuucacauggccgccuggagcggguccgccugccacgacggcaaggaguggacguacaucggcgucgacgggccggacaauaacgcccuccugaaggugaaguacggcgaggcguacaccgacaccuaccacucguaugccaacaagauccugcgcacccaggaguccgccugcaacugcaucgggggcaacugcuaccucaugaucacggauggcagcgccagcgggguguccgagugccgguuccugaagauccgcgagggccggaucaucaaggagaucuuccccaccgggcgcgucaagcacaccgaggagugcacgugcggcuuugccucgaacaagaccaucgagugcgcgugccgggacaacuccuacaccgccaagcgccccuuugugaagcugaacguggagaccgacaccgccgagauccggcucaugugcacggacaccuaccuggacacgccccgcccggacgaugggagcaucaccggccccugcgaguccaacggcgacaaggggagcggcgggaucaagggcggguucguccaccagcggauggaguccaagaucggccgcugguacagucggaccauguccaagaccgagcgcaugggcauggggcuguacgugaaguacgacggcgaccccugggccgacagcgacgcccucgcguuuuccggggugauggucagcaugaaggagcccggcugguacuccuucggguucgagaucaaggacaagaagugcgacgugccguguaucggcaucgagauggugcacgacggcgggaaggagaccuggcacagcgccgccaccgccaucuacugccugaugggcuccgggcagcugcucugggacacggucaccggcguggacauggcccuguga

SEQ ID NO: 29041 - RNA, 1401 nt, Artificial Sequence; identical to SEQ ID NO: 28988
  derived and/or modified CDS sequence (AUadapt) from InfluenzaB__AET50969__NA

SEQ ID NO: 29042 - RNA, 1401 nt, Artificial Sequence; identical to SEQ ID NO: 28988
  derived and/or modified CDS sequence (AUadapt) from InfluenzaB__AET50980__NA

SEQ ID NO: 29043 - RNA, 1401 nt, Artificial Sequence; identical to SEQ ID NO: 28988
  derived and/or modified CDS sequence (AUadapt) from InfluenzaB__AET74259__NA

SEQ ID NO: 29044 - RNA, 1401 nt, Artificial Sequence; identical to SEQ ID NO: 28988
  derived and/or modified CDS sequence (AUadapt) from InfluenzaB__AET74270__NA

SEQ ID NO: 29045 - RNA, 1401 nt, Artificial Sequence; identical to SEQ ID NO: 29039
  derived and/or modified CDS sequence (AUadapt) from InfluenzaB__AET74281__NA

SEQ ID NO: 29046 - RNA, 1401 nt, Artificial Sequence; identical to SEQ ID NO: 28988
  derived and/or modified CDS sequence (AUadapt) from InfluenzaB__AET74292__NA

SEQ ID NO: 29047 - RNA, 1401 nt, Artificial Sequence; identical to SEQ ID NO: 28988
  derived and/or modified CDS sequence (AUadapt) from InfluenzaB__AET74303__NA

SEQ ID NO: 29048 - RNA, 1401 nt, Artificial Sequence; identical to SEQ ID NO: 28988
  derived and/or modified CDS sequence (AUadapt) from InfluenzaB__AET74314__NA

SEQ ID NO: 29049 - RNA, 1401 nt, Artificial Sequence; identical to SEQ ID NO: 28988
  derived and/or modified CDS sequence (AUadapt) from InfluenzaB__AET74333__NA

SEQ ID NO: 29050 - RNA, 1401 nt, Artificial Sequence
  derived and/or modified CDS sequence (AUadapt) from InfluenzaB__AET74344__NA
augcugcccaguaccauccagacccucacgcuguuccugaccuccggcggggugcuccugagccuguacgucuccgccagccucuccuaccugcuguacagugacauccuccugaaguucuccccgaaggagaucaccgcccccaccaugccccuggacugcgcgaacgccagcaaugugcaggccgugaaccacuccgccacgaagggcgucacccuccugcugcccgagccggaguggaccuacccccgccucagcugccccggguccaccuuccagaaggcccugcugaucagcccccaucgguucggcgagacgaaggggaacuccgcgccgcucaucauccgcgagcccuucaucgccugcggccccaacgagugcaagcauuucgcccugacccacuacgccgcgcagcccggcggguacuacaacggcacccgcggggaucggaacaagcugcggcaccucaucucggugaagcugggcaagaucccgaccguggagaacuccaucuuccacauggccgccuggagcggguccgccugucacgacggcaaggaguggacguacaucggcgucgacgggcccgacaacaaugcccugcucaaggugaaguacggcgaggcguacaccgacaccuaccacagcuaugccaacaagauccugcgcacccaggaguccgccugcaacugcaucgggggcaacugcuaccugaugaucacggauggcagcgccucggggguguccgagugccgguuccucaagauccgcgagggccggaucaucaaggagaucuuccccaccgggcgcgucaagcacaccgaggaguguacgugcggcuucgccagcaacaagaccaucgagugcgcgugccgggauaacuccuacaccgccaagcgccccuucgugaagcugaacguggaggccgacaccgccgagauccggcugaugugcaccgacacguaucucgacaccccgcgccccgacgacgggagcaucaccggccccugcgaguccaacggcgauaaggggagcggcgggaucaagggcggguucguccaccagcggauggaguccaagaucggccgcugguacucgcggaccauguccaagacggagcgcaugggcauggggcuguacgugaaguaugacggcgaccccugggccgacagcgacgcgcuggccuucuccggggugauggucagcaugaaggagccgggcugguauuccuucggguucgagaucaaggacaagaagugcgacgugcccugcaucggcaucgagauggugcaugacggcgggaaggagaccuggcacagcgccgccaccgccaucuacugccucaugggcuccgggcagcugcugugggacaccgucacgggcguggacauggcgcucuga

SEQ ID NO: 29051 - RNA, 1401 nt, Artificial Sequence; identical to SEQ ID NO: 28988
  derived and/or modified CDS sequence (AUadapt) from InfluenzaB__AET74355__NA

SEQ ID NO: 29052 - RNA, 1404 nt, Artificial Sequence
  derived and/or modified CDS sequence (AUadapt) from InfluenzaB__AEY75594__NA
augcugcccaguaccauccagaugcucacccuguuccugacguccggcggggugcuccugagccuguacgucuccgccagccucuccuaccugcuguacagugacauccuccugaaguucuccccgaccgagaucaccgcccccaccaugccccuggacugcgcgaacgccagcaacgugcaugccgugaaccgcuccgccacgaagggcgucaccuuccuccugcugcccgagccggaguggaccuacccccggcucagcugccccggguccaccuuccagaaggcccugcugaucucgccccaucgcuucggcgagacgaaggggaacuccgcgccgcucaucauccgggagcccuucaucgccugcggccccaacgagugcaagcacuuugcccugacccacuacgccgcgcagcccggcggguacuacaacggcacccgcggggaccggaacaagcugcgccaucucaucagcgugaagcugggcaagaucccgaccguggagaacuccaucuuccacauggccgccuggagcggguccgccugccacgauggcaaggaguggacguacaucggcgucgacgggcccgacaacaacgcccugcucaagaucaaguacggcgaggcguacaccgauaccuaccacucguacgccaacaacauccugcggacccaggaguccgccugcaauugcaucgggggcaacugcuaccugaugaucacggacggcagcgccagcgggguguccgagugucgcuuccucaagauccgggagggccgcaucaucaaggagaucuuccccaccgggcgggugaagcacaccgaggagugcacgugcggcuucgccucgaauaagaccaucgagugcgcgugccgcgacaacuccuacaccgccaagcggcccuucgucaagcugaacguggagaccgauaccgccgagauccgccugaugugcacggacaccuaccucgacaccccgcggcccgacgacgggagcaucaccggccccugugaguccaacggcgacaaggggagcggcgggacgaagggcggguucgugcaccagcgcauggccuccaagaucggccggugguacucgcgcaccauguccaagaccgagcggaagggcauggggcuguaugucaaguacgacggcgaccccuggaccgacagcgacgcccuggcguuccgcggggugaugguguccaugaaggagccgggcugguauagcuucggguucgagaucaaggacaagaagugcgacguccccugcaucggcaucgagauggugcaugacggcgggaaggagacguggcacuccgccgccaccgccaucuacugccucaugggcagcgggcagcugcugugggacaccgugaccggcgucgacauggcccucuga

SEQ ID NO: 29053 - RNA, 1401 nt, Artificial Sequence
  derived and/or modified CDS sequence (AUadapt) from InfluenzaB__AFA45223__NA
augcugcccaguaccauccagacccucacgcuguuccugaccuccggcggggugcuccugagccuguacgucuccgcccuccugagcuaccugcucuacuccgauauccugccgaaguucagccccaccgagaucaccgcccccacgaugucccuggacugcgcgaacgccagcaaugugcaggccgugaaccgcuccgccaccaagggcgucaccuuccuccugucggagcccgaguggaccuacccgcggcuguccugccccgggagcacguuccagaaggcccuccugaucaguccccaccgcuucggcgagaccaaggggaacuccgcgccccugaucauccgggagccguucaucgccugcggccccaacgaguguaagcacuucgcccucacccacuacgccgcgcagcccggcggguacuacaacggcacccgcggggaucggaacaagcugcgccaccugaucuccgugaagcucggcaagauccccacgguggagaacagcaucuuccacauggccgccugguccgggagugccugccacgacggcaaggaguggaccuacaucggcgucgacgggccggacaaugacgcccugcugaaggugaaguacggcgaggcguacaccgacaccuaccacuccuacgccaauaagauccuccggacgcaggagucggccugcaacugcaucgggggcaacugcuaucugaugaucaccgacggcagcgccuccggggugagcgagugccgcuuccugaagauccgggagggccgcaucaucaaggagaucuuccccaccgggcgggucaagcacaccgaggaguguacgugcggcuucgccuccaacaagaccaucgagugcgcgugccgcgacaauagcuacaccgccaagcggcccuucgugaagcucaacguggagaccgacacggccgagauccgccugaugugcaccgauaccuaccuggacacgccccggccggacgacggguccaucaccggccccugcgagagcaacggcgauaagggguccggcgggaucaagggcggguucguccaccagcgcauggagucgaagaucggccggugguacucccgcaccaugagcaagaccgagcggaugggcauggggcucuacgugaaguaugacggcgaccccugggccgacuccgacgcccuggcguucagcggggugauggucuccaugaaggagcccggcugguacaguuucggguucgagaucaaggacaagaagugcgacgugccgugcaucggcaucgagauggugcaugacggcgggaaggagaccuggcacuccgccgccacggccaucuacugccugaugggcagcgggcagcuccugugggacaccgucaccggcguggacauggcccuguga

SEQ ID NO: 29054 - RNA, 1401 nt, Artificial Sequence
  derived and/or modified CDS sequence (AUadapt) from InfluenzaB__AFA45226__NA
augcugcccaguaccauccagacccucacgcuguuccugaccuccggcggggugcuccugagccuguacgucuccgccagccucuccuaccugcuguauagcgacauccuccugaaguucuccccgaccgagaccacggcccccaccaugagccuggacugugcgaacgccuccaacgugcaggccgugaaccgcagcgccaccaagggcgucaccuuccuccugcccgagcccgaguggacguauccgcggcuguccugccccgggagcaccuuccagaaggcccuccugaucagcccccaccgcuucggcgagaccaaggggaauuccgcgccccugaucauccgggagccguucaucgccugcggccccaacgagugcaagcacuuugcccucacccacuacgccgcgcagcccggcggguacuacaacggcacgcgcggggaucggaacaagcugcgccaccugaucuccgugaagcucggcaaggugcccaccgucgagaacagcaucuuccacauggccgccugguccgggagugccugccacgacggcaaggaguggaccuacaucggcguggacgggccggauaacgacgcccugcugaaggugaaguacggcgaggcguacaccgacacguaucacuccuacgccaacaagauccuccggacccaggagucggccugcaacuguaucgggggcaacugcuaccugaugaucaccgacggcagcgccuccggggucagugagugccgcuuccugaagauccgggagggccgcaucaucaaggagaucuuccccaccgggcgggugaagcacacggaggagugcacguguggcuucgccuccaacaagaccaucgagugcgcgugccgcgacaauagcuacaccgccaagcggcccuucgugaagcucaacgucgagaccgacaccgccgagauccgccugaugugcaccgauaccuaccuggacacgccccggccggacgacggguccaucaccggccccugcgagaguaacggcgacaagggguccggcgggaucaagggcggguucgugcaccagcgcauggagagcaagaucggccggugguauucccgcaccaugagcaagaccgagcggaugggcauggggcucuacgugaaguacgacggcgaccccugggccgacuccgaugcccuggcguucagcggggucaugguguccaugaaggagcccggcugguacagcuucggguuugagaucaaggacaagaagugcgacgugccgugcaucggcaucgagaugguccacgauggcgggaagggcacguggcacuccgccgccaccgccaucuacugccugauggggagcggccagcuccugugggacaccgugaccggcguggacauggcccuguga

SEQ ID NO: 29055 - RNA, 1401 nt, Artificial Sequence
  derived and/or modified CDS sequence (AUadapt) from InfluenzaB__AFA45229__NA
augcugcccaguaccauccagacccucacgcuguuccugaccuccggcggggugcuccugagccuguacgucuccgcccuccugagcuaccugcucuauuccgacauccugcugaaguucagcccgaccgagaucaccgcccccacgaugccccucgacugcgcgaacgccuccaaugugcaggccgugaaccgcagcgccaccaagggcgucaccuuccugcugcccgagccggaguggaccuacccccggcucuccugccccgggagcacguuucagaaggcccugcugaucucgccccaccgcuucggcgagaccaaggggaacuccgcgccgcucaucauccgggagcccuucaucgccugcggccccaaugagugcaagcacuucgcccugacccacuacgccgcgcagcccggcggguacuauaacggcacccgcggggaccggaacaagcugcgccaccucaucuccgugaagcugggcaagaucccgacgguggagaacagcaucuuucacauggccgccugguccgggagcgccugccacgacggcaaggaguggaccuacaucggcgucgaugggcccgacaacgacgcccugcucaaggugaaguacggcgaggcguacaccgacaccuaucacuccuacgccaacaagauccugcggacgcaggagagcgccugcaacuguaucgggggcaacugcuaccugaugaucaccgacggcuccgccagcggggugagcgagugucgcuuccucaagauccgggagggccgcaucaucaaggagaucuuccccaccgggcgggucaagcacaccgaggagugcacgugcggcuucgccuccaauaagaccaucgagugcgcgugccgcgacaacucguacaccgccaagcggcccuuugugaagcugaacguggagaccgacacggccgagauccgccugaugugcaccgacaccuaccucgacaccccgcggcccgaugacggguccaucacgggccccugcgagagcaacggcgacaagggguccggcgggaucaagggcggguucguccaucagcgcauggagagcaagaucggccggugguacucccgcaccaugagcaagaccgagcggaugggcauggggcuguacgugaaguacgacggcgaucccugggccgacuccgacgcccuggcguucagcggggugauggucuccaugaaggagccgggcugguacagcuuuggguucgagaucaaggacaagaagugcgacgugcccugcaucggcaucgagauggugcacgauggcgggaaggagaccuggcacuccgccgccacggccaucuacugccucaugggcagcgggcagcugcugugggacaccgucaccggcguggacauggcccucuga

SEQ ID NO: 29056 - RNA, 1401 nt, Artificial Sequence; identical to SEQ ID NO: 28662
  derived and/or modified CDS sequence (AUadapt) from InfluenzaB__AFA45235__NA

SEQ ID NO: 29057 - RNA, 1401 nt, Artificial Sequence
  derived and/or modified CDS sequence (AUadapt) from InfluenzaB__AFA45238__NA
augcugcccaguaccauccagacccucacgcuguuccugaccuccggcggggugcuccugagccuguacgucuccgccagccucuccuaccugcuguacagugacauccuccugaaguucuccccgaccaagaccacggcccccaccaugucgcuggacugcgcgaacgccuccaaugugcaggccgugaaccgcagcgccaccaagggcgucaccuuccuccugcccgagcccgaguggacguacccgcggcuguccugccccgggagcaccuuccagaaggcccuccugaucaguccccaccgcuucggcgagaccaaggggaacuccgcgccccugaucauccgggagccguucaucgccugcggccccaacgaguguaagcacuucgcccucacccacuacgccgcgcagcccggcggguacuacaacggcacgcgcggggaucggaacaagcugcgccaccugaucuccgugaagcucggcaagauccccaccguggagaacucgaucuuccacauggccgccugguccgggagugccugccacgacggcaaggaguggaccuacaucggcgucgacgggccggacaaugacgcccugcugaaggugaaguacggcgaggcguacaccgacacguaccacuccuacgccaauaagauccuccggacccaggagagcgccugcaacugcaucgggggcaacugcuaucugaugaucaccgacggcagcgccuccggggugucggagugccgcuuccugaagauccgggagggccgcaucaucaaggagaucuuccccaccgggcgggucaagcacacggaggaguguacgugcggcuucgccuccaacaagaccaucgagugcgcgugccgcgacaauagcuacaccgccaagcggcccuucgugaagcucaacguggagaccgacaccgccgagauccgccugaugugcaccgauaccuaccuggacacgccccggccggacgacggguccaucaccggccccugcgagagcaacggcgauaagggguccggcgggaucaagggcggguucguccaccagcgcauggagagcaagaucggccggugguacucccgcaccaugucgaagaccgagcggaugggcauggggcucuacgugaaguaugacggcgaccccugggccgacuccgacgcccuggcguucagcggggugauggucuccaugaaggagcccggcugguacaguuucggguucgagaucaaggacaagaagugcgacgugccgugcaucggcaucgagauggugcaugacggcgggaaggagacguggcacuccgccgccaccgccaucuacugccugaugggcagcgggcagcuccugugggacaccgucaccggcguggacauggcccuguga

SEQ ID NO: 29058 - RNA, 1401 nt, Artificial Sequence
  derived and/or modified CDS sequence (AUadapt) from InfluenzaB__AFA45241__NA
augcugcccaguaccauccagacccucacgcuguuccugaccuccggcggggugcuccugagccuguacgucuccgccagccucuccuaccugcuguacucggauauccuccugaaguucuccccgaccgagaucaccgcccccacgaugccccuggacugcgcgaacgccagcaacgugcaggccgugaaccgcuccgccaccaagggcgucaucuuucuccugcccgagccggaguggaccuacccccggcugagcugccccggguccaccuuccagaaggcccuccugaucagcccccaccgcuucggcgagacgaaggggaacuccgcgccgcugaucauccgggagcccuuuaucgccugcggccccaacgagugcaagcacuucgcccucacccacuacgccgcgcagcccggcggguauuacaacggcacccgcggggaccggaacaagcugcgccaccugaucucggugaagcucggcaagaucccgaccguggagaacuccaucuuucacauggccgccuggagcggguccgccugccacgacggcaaggaguggacguacaucggcgucgacgggcccgacaauaacgcccugcugaaggugaaguacggcgaggcguacaccgacaccuaccacagcuaugccaacaagauccuccggacccaggaguccgccugcaacugcaucgggggcaacugcuaccugaugaucacggauggcagcgccucggggguguccgagugccgcuuccugaagauccgggagggccgcaucaucaaggagaucuuccccaccgggcgggucaagcacaccgaggagugcacgugcggcuuugccagcaacaagaccaucgagugcgcgugccgcgacaacuccuacaccgccaagcggcccuuugugaagcucaacguggagaccgacaccgccgagauccgccugaugugcacggacaccuaccuggacaccccgcggcccgacgaugggagcaucaccggccccugcgaguccaacggcgacaaggggagcggcgggaucaagggcggguucguccaccagcgcauggaguccaagaucggccggugguacagucgcacgauguccaagaccgagcggaugggcauggggcucuacgugaaguacgacggcgaccccugggccgacagcgacgcccugaccuuuuccggggugauggucagcaugaaggagccgggcugguacuccuucggguucgagaucaaggacaagaagugcgacgugcccuguaucggcaucgagauggugcacgacggcgggaaggagaccuggcacagcgcggccacggccaucuacugccugaugggcuccgggcagcuccugugggacaccgucaccggcguggacauggcccuguga

SEQ ID NO: 29059 - RNA, 1401 nt, Artificial Sequence
  derived and/or modified CDS sequence (AUadapt) from InfluenzaB__AFA45244__NA
augcugcccaguaccauccagacccucacgcuguuccugaccuccggcggggugcuccugagccuguacgucuccgccagccucuccuaccugcuguacagugacauccuccugaaguucuccccgaccgagaccacggcccccaccaugucgcuggacugcgcgaacgccuccaaugugcaggccgugaaccgcagcgccaccaagggcgucaccuuccuccugcccgagcccgaguggacguacccgcggcuguccugccccgggagcaccuuccagaaggcccuccugaucaguccccaccgcuucggcgagaccaaggggaacuccgcgccccugaucauccgggagccguucaucgccugcggccccaacgaguguaagcacuucgcccucacccacuacgccgcgcagcccggcggguacuacaacggcacgcgcggggaucggaacaagcugcgccaccugaucuccgugaagcucggcaagauccccaccguggagaacucgaucuuccacauggccgccugguccgggagugccugccacgacggcaaggaguggaccuacaucggcgucgacgggccggacaaugacgcccugcugaaggugaaguacggcgaggcguacaccgacacguaccacuccuacgccaauaagauccuccggacccaggagagcgccugcaacugcaucgggggcaacugcuaucugaugaucaccgacggcagcgccuccggggugucggagugccgcuuccugaagauccgggagggccgcaucaucaaggagaucuuccccaccgggcgggucaagcacacggaggaguguacgugcggcuucgccuccaacaagaccaucgagugcgcgugccgcgacaauagcuacaccgccaagcggcccuucgugaagcucaacguggagaccgacaccgccgagauccgccugaugugcaccgauaccuaccuggacacgccccggccggacgacggguccaucaccggccccugcgagagcaacggcgauaagggguccggcgggaucaagggcggguucguccaccagcgcauggagagcaagaucggccggugguacucccgcaccaugucgaagaccgagcggaugggcauggggcucuacgugaaguaugacggcgaccccugggccgacuccgacgcccuggcguucagcggggugauggucuccaugaaggagcccggcugguacaguuucggguucgagaucaaggacaagaagugcgacgugccgugcaucggcaucgagauggugcaugacggcgggaagaagacguggcacuccgccgccaccgccaucuacugccugaugggcagcgggcagcuccugugggacaccgucaccggcguggacauggcccuguga

SEQ ID NO: 29060 - RNA, 1401 nt, Artificial Sequence
  derived and/or modified CDS sequence (AUadapt) from InfluenzaB__AFA45247__NA
augcugcccaguaccauccagacccucacgcuguuccugaccuccggcggggugcuccugagccuguacgucuccgccagccucuccuaccugcuguacagugacauccuccugaaguucuccaccaccgagaucacggccccgaccaugccccuggacugcgcgaacgccucgaaugugcaggccgugaaccgcuccgccaccaagggcgucacccuccugcugcccgagcccgaguggacguacccgcggcucagcugccccggguccaccuuccagaaggcccugcugaucagcccccaucgcuucggcgagaccaaggggaacuccgcgccccucaucauccgggagccguucaucgccugcggccccaacgagugcaagcacuuugcccugacccacuacgccgcgcagcccggcggguacuacaacggcacgcgcggggaccggaauaagcugcgccaccucaucagcgugaagcugggcaagauccccaccguggagaacuccaucuuccacauggccgccuggagcggguccgccugucacgacggcaaggaguggaccuacaucggcgucgacgggccggacaacaacgcccugcucaaggugaaguauggcgaggcguacaccgacacguaccacucguacgccaauaagauccugcggacccaggaguccgccugcaacugcaucgggggcaacugcuaccugauggugaccgauggcagcgccagcggggucuccgagugccgcuuccucaagauccgggagggccgcaucaucaaggagaucuuccccaccgggcgggugaagcacacggaggaguguacgugcggcuucgccagcaacaagaccaucgagugcgcgugccgcgacaauuccuacaccgccaagcggcccuucgugaagcugaacgucgagaccgacaccgccgagauccgccugaugugcaccgacaccuaucucgacacgccccggccggacgacgggagcaucaccggccccugcgaguccaacggcgauaaggggucgggcgggaucaagggcggguucgugcaccagcgcauggaguccaagaucggccggugguacagccgcaccauguccaagaccgagcggaugggcauggggcuguacgugaaguacgauggcgaccccugggccgacagcgacgcccuggucuucuccggggugauggugagcaugaaggagcccggcugguauuccuucggguucgagaucaaggacaagaagugcgacgucccgugcaucggcaucgagauggugcaugacggcgggaaggagacguggcacagcgcggccaccgccaucuacugccucaugggcuccgggcagcugcugugggacaccgugaccggcgucgacauggcccucuga

SEQ ID NO: 29061 - RNA, 1401 nt, Artificial Sequence; identical to SEQ ID NO: 29011
  derived and/or modified CDS sequence (AUadapt) from InfluenzaB__AFA45250__NA

SEQ ID NO: 29062 - RNA, 1401 nt, Artificial Sequence
  derived and/or modified CDS sequence (AUadapt) from InfluenzaB__AFA45253__NA
augcugcccaguaccauccagacccucacgcuguuccugaccuccggcggggugcuccugagccuguacgucuccgcccuccugagcuaccugcucuacuccgauauccugcugaaguucagcccgaccgagaucaccgcccccacgaugucccucgacugcgcgaacgccagcaacgugcaggccgugaaucgcuccgccaccaagggcgucaccuuccugcugcccgagcccgaguggaccuacccgcggcucagcugccccggguccacguuccagaaggcccugcugaucucgccccaccgcuuuggcgagaccaaggggaacuccgcgccccucaucauccgggagccguucaucgccugcggccccaacgagugcaagcacuucgcccugacccauuacgccgcgcagcccggcggguacuacaacggcacccgcggggaccggaacaagcugcgccaccucaucagugugaagcugggcaagauccccacgguggagaacuccaucuuccacauggccgccuggagcggguccgccugccacgauggcaaggaguggaccuacaucggcgucgacgggccggacaacgacgcccugcucaaggugaaguacggcgaggcguacaccgauaccuaccacagcuacgccaacaagauccugcggacgcaggaguccgccugcaacuguaucgggggcaacugcuaccugaugaucaccgacggcagcgccagcgggguguccgagugccgcuuucucaagauccgggagggccgcaucaucaaggagaucuuccccaccgggcgggucaagcacaccgaggagugcacgugcggcuucgccucgaacaagaccaucgagugugugugccgcgacaacuccuacaccgcgaagcggcccuucgugaagcugaacgucgagaccgauacggccgagauccgccugaugugcaccgacaccuaccucgacacgccccggccggacgacgggagcaucaccggccccugugaguccaacggcgacaaggggagcggcgggaucaagggcggguucgugcaccagcgcauggaguccaagaucggccggugguacagccgcaccauguccaagaccgagcggaugggcauggggcuguaugugaaguacgacggcgaccccugggccgacagcgacgcccuggccuucuccggggucauggugaguaugaaggagcccggcugguacuccuucggguucgagaucaaggacaagaagugcgacgugccgugcaucggcaucgagaugguccaugacggcgggaaggagaccuggcacagcgcggccacggccaucuacugccucaugggcuccgggcagcugcugugggacaccgugaccggcguggacauggcccucuga

SEQ ID NO: 29063 - RNA, 1401 nt, Artificial Sequence
  derived and/or modified CDS sequence (AUadapt) from InfluenzaB__AFB77645__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccgcgaugccccuggacugcgccaacgccaguaacgugcaggccgugaaccgcuccgccacgaagggcgucacccuccugcugcccgagccggaguggaccuacccccggcucagcugccccggguccaccuuccagaaggcgcugcugaucaguccccaccgcuucggcgagacgaaggggaacuccgccccgcucaucauccgggagcccuucaucgccugcggccccaacgaguguaagcacuucgcccugacccacuacgcggcccagcccggcggguacuacaauggcacccgcggggaccggaacaagcugcgccaccucaucagcgugaagcugggcaagaucccgaccguggagaacuccaucuuccauauggccgccuggagcggguccgccugccacgacggcaaggaguggacguacaucggcgucgacgggcccgauaacaacgcgcugcucaaggugaaguacggcgaggccuacaccgacaccuaccauagcuacgccaacaagauccugcggacccaggaguccgccugcaacugcaucgggggcaauugcuaccugaugaucacggacggcagcgccagcgggguguccgagugucgcuuccucaagauccgggagggccgcaucaucaaggagaucuuccccaccgggcgggucaagcacaccgaggagugcacgugcggcuucgcgaguaacaagaccaucgagugcgccugccgcgacaacuccuacaccgccaagcggcccuuugugaagcugaacguggagaccgacaccgccgagauccgccugaugugcacggacaccuaccucgacaccccgcggcccaaugacgggagcaucaccggccccugcgaguccgacggcgacaaggggagcggcgggaucaagggcggguuuguccaccagcgcauggaguccaagaucggccggugguacagccgcacgauguccaagaccgagcggaugggcauggggcuguacgugaaguacgacggcgaucccugggccgacagcgacgcgcugguguucuccggggucauggugagcaugaaggagccgggcugguacuccuuuggguucgagaucaaggacaagaagugcgacgugcccugcaucggcaucgagaugguccacgauggcgggaaggagaccuggcacagcgccgccaccgccaucuacugccucaugggcuccgggcagcugcugugggacacggugaccggcguggacauggcccucuga

SEQ ID NO: 29064 - RNA, 1401 nt, Artificial Sequence
  derived and/or modified CDS sequence (AUadapt) from InfluenzaB__AFB77647__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccgcgaucccccuggacugcgccaacgccaguaacgugcaggccgugaaccgcuccgccacgaagggcgucacccuccugcugcccgagccggaguggaccuacccccggcucagcugccccggguccaccuuucagaaggcgcugcugaucucgccccaccgcuucggcgagacgaaggggaacuccgccccgcucaucauccgggagcccuucaucgccugcggccccaaugagugcaagcacuucgcccugacccacuacgcggcccagcccggcggguauuacaacggcacccgcggggaccggaacaagcugcgccaccucaucagcgugaagcugggcaagaucccgaccguggagaauuccaucuuccacauggccgccuggagcggguccgccugccacgauggcaaggaguggacguacaucggcgucgacgggcccgacaacaacgcgcugcucaaggugaaguacggcgaggccuauaccgacaccuaccacagcuacgccaauaagauccugcggacccaggaguccgccugcaacugcaucgggggcaacugcuaccugaugaucacggauggcagcgccagcgggguguccgagugccgcuuccucaagauccgggagggccgcaucaucaaggagaucuuccccaccgggcgggucaagcauaccgaggagugcacgugcggcuucgcgucgaacaagaccaucgagugcgccugucgcgacaacuccuacaccgccaagcggcccuucgugaagcugaacguggagaccgauaccgccgagauccgccugaugugcacggacaccuaccucgacaccccgcggcccaacgacgggaguaucaccggccccugcgaguccgacggcgacaaggggagcggcgggaucaagggcggguucguccaucagcgcauggaguccaagaucggccggugguacagccgcacgauguccaagaccgagcggaugggcauggggcuguacgugaaguacgacggcgaccccugggccgauagcgacgcgcuggccuucuccggggugauggucagcaugaaggagccgggcugguacuccuuuggguucgagaucaaggacaagaagugcgacgugcccugcaucggcaucgagauggugcacgauggcgggaaggagaccuggcacagcgccgccaccgccaucuacugccucaugggcuccgggcagcugcugugggacacggucaccggcguggacauggcgcucuga

SEQ ID NO: 29065 - RNA, 1401 nt, Artificial Sequence
  derived and/or modified CDS sequence (AUadapt) from InfluenzaB__AFB77649__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccgcgaugccccuggacugcgccaacgccaguaacgugcaggccgugaaccgcuccgccacgaagggcgucacccuccugcugcccgagccggaguggaccuacccccggcucagcugccccggguccaccuuccagaaggcgcugcugaucaguccccaccgcuucggcgagacgaaggggaacuccgccccgcucaucauccgggagcccuucaucgccugcggccccaacgaguguaagcacuucgcccugacccacuacgcggcccagcccggcggguacuacaauggcacccgcggggaccggaacaagcugcgccaccucaucagcgugaagcugggcaagaucccgaccguggagaacuccaucuuccauauggccgccuggagcggguccgccugccacgacggcaaggaguggacguacaucggcgucgacgggcccgauaacaacgcgcugcucaaggugaaguacggcgaggccuacaccgacaccuaccauucguacgccaacaagauccugcggacccaggaguccgccugcaacugcaucgggggcaauugcuaccugaugaucacggacggcagcgccagcgggguguccgagugucgcuuccucaagauccgggagggccgcaucaucaaggagaucuuccccaccgggcggaucaagcacaccgaggagugcacgugcggcuucgcgaguaacaagaccaucgagugcgccugccgcgacaacuccuacaccgccaagcggcccuuugucaagcugaacguggagaccgacaccgccgagauccgccugaugugcacggacaccuaccucgacaccccgcggcccaaugacgggagcaucaccggccccugcgaguccgacggcgacaaggggucgggcgggaucaagggcggguuugugcaccagcgcauggaguccaagaucggccggugguacagccgcacgauguccaagaccgagcggaugggcauggggcuguacgucaaguacgacggcgaucccugggccgacagcgacgcgcuggccuucuccggggugauggugagcaugaaggagccgggcugguacuccuuuggguucgagaucaaggacaagaagugcgacguccccugcaucggcaucgagauggugcacgauggcgggaaggagaccuggcacagcgccgccaccgccaucuacugccucaugggcuccgggcagcugcugugggacacggugaccggcgucgacauggcgcucuga

SEQ ID NO: 29066 - RNA, 1401 nt, Artificial Sequence
  derived and/or modified CDS sequence (AUadapt) from InfluenzaB__AFB77651__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccgcgaugccccuggacugcgccaaugccagcaacgugcaggccgugaaccgcuccgccacgaagggcgucacccuccugcugcccgagccggaguggaccuacccccggcucagcugucccggguccaccuuccagaaggcgcugcugaucucgccccaccgcuucggcgagacgaaggggaacuccgccccgcucaucauccgggagcccuuuaucgccugcggccccaacgagugcaagcacuucgcccugacccacuaugcggcccagcccggcggguacuacaacggcacccgcggggaccggaacaagcugcgccaucucaccagcgugaagcugggcaagaucccgacgguggagaacuccaucuuccacauggccgccuggagcggguccgccugucacgacggcaaggaguggaccuacaucggcgucgacgggcccgacaauaacgcgcugcucaaggugaaguacggcgaggccuacaccgacaccuaccauagcuacgccaacaagauccugcggacgcaggaguccgccugcaacugcaucgggggcaauugcuaccugaugaucaccgacggcagcgccagcgggguguccgagugucgcuuccucaagauccgggagggccgcaucaucaaggagaucuuccccaccgggcgggucaagcacaccgaggagugcacgugcggcuuugcgucgaacaagaccaucgagugcgccugccgcgacaauuccuacaccgccaagcggcccuucgugaagcugaacguggagaccgacacggccgagauccgccugaugugcaccgauaccuaccucgacaccccgcggcccaacgacgggagcaucacgggccccugcgaguccgauggcgacaaggggagcggcgggaucaagggcggguucguccaccagcgcauggaguccaagaucggccggugguacagucgcaccauguccaagaccgagcggaugggcauggggcuguacgugaaguacgacggcgaccccugggccgacagugacgcgcuggccuucuccggggugauggucagcaugaaggagccgggcugguacuccuucggguuugagaucaaggacaagaagugcgacgugcccugcaucggcaucgagauggugcacgauggcgggaaggagaccuggcacagcgccgccacggccaucuacugccucaugggcuccgggcagcugcugugggacaccgucaccggcguggacauggcgcucuga

SEQ ID NO: 29067 - RNA, 1401 nt, Artificial Sequence
  derived and/or modified CDS sequence (AUadapt) from InfluenzaB__AFE00364__NA
augcugcccaguaccauccagaugcucacccuguuccugacguccggcggggugcuccugagccuguacgucuccgccagccucuccuaccugcuguacagugacauccuccugaaguucuccccgaccgagaucaccgcccccaccaugccccuggacugcgcgaacgccucgaaugugcacgccgugaaccgguccgccacgaagggcgucaccuuccuccugcccgagccggaguggaccuacccccggcugagcugccccggguccaccuuucagaaggcccuccugaucagcccccaccgcuucggcgagacgaaggggaacuccgcgccgcugaucauccgggagcccuucaucgccugcggccccaaugagugcaagcacuucgcccucacccacuacgccgcgcagcccggcggguacuauaacggcacccgcggggaccggaaccgccugcggcaccugaucagcgugaagcucggcaagaucccgaccguggagaacuccaucuuucacauggccgccuggagcggguccgccugccacgacggcaaggaguggacguacaucggcgucgaugggcccgacaacaacgcccugcugaagaucaaguacggcgaggcguacaccgacaccuaucacucguacgccaacaacauccuccgcacccaggaguccgccugcaauugcaucgggggcaacugcuaccugaugaucacggacggcagcgccagugggguguccgagugccgguuccugaagauccgcgagggccggaucaucaaggagaucuuccccaccgggcgcgugaagcacaccgaggagugcacgugcggcuuugccagcaacaagaccaucgagugcgcgugccgggacaacuccuauaccgccaagcgccccuucgucaagcucaacguggagaccgacaccgccgagauccggcugaugugcacggacaccuaccuggauaccccgcgccccgacgacgggagcaucaccggccccugcgaguccaacggcgacaaggggaguggcgggaucaagggcggguucgugcaccagcggauggccuccaagaucggccgcugguacagccggacgauguccaagaccgagcgcaagggcauggggcucuacgucaaguacgauggcgaccccuggaccgacagcgacgcccuggcguuccgcggggugaugguguccaugaaggagccgggcugguacaguuucggguucgagaucaaggacaagaagugcgacguccccugcaucggcaucgagauggugcaugacggcgggaaggagaccuggcacuccgccgccacggccaucuacugccugaugggcagcgggcagcuccugugggacaccgugaccggcgucgacauggcccuguga

SEQ ID NO: 29068 - RNA, 1401 nt, Artificial Sequence
  derived and/or modified CDS sequence (AUadapt) from InfluenzaB__AFF18536__NA
augcugcccaguaccauccagaugcucacccuguuccugacguccggcggggugcuccugagccuguacgucuccgccagccucuccuaccugcuguacagugacauccuccugaaguucuccccgaccgagaucaccgcccccaccaugccccuggacugcgcgaacgccucgaaugugcacgccgugaaccgcuccgccacgaagggcgucaccuuccuccugcccgagccggaguggaccuacccccggcugagcugccccggguccaccuuucagaaggcccuccugaucagcccccaccgcuucggcgagacgaaggggaacuccgcgccgcugaucauccgggagcccuucaucgccugcggccccaaugagugccgccacuucgcccucacccacuacgccgcgcagcccggcggguacuauaacggcacccgcggggaccggaacaagcugcggcaccugaucagcgugaagcucggcaagaucccgaccguggagaacuccaucuuucacauggccgccuggagcggguccgccugccacgacggcaaggaguggacguacaucggcgucgaugggcccgacaacaacgcccugcugaagaucaaguacggcgaggcguacaccgacaccuaucacucguacgccaacaacauccuccgcacccaggaguccgccugcaauugcauccgggggaacugcuaccugaugaucacggacggcagcgccaguggcguguccgagugccgcuuccugaagauccgggaggggcgcaucaucaaggagaucuuccccaccggccgggugaagcacaccgaggagugcacgugcggguuugccagcaacaagaccaucgagugcgcgugccgcgacaacuccuauaccgccaagcggcccuucgucaagcucaacguggagaccgacaccgccgagauccgccugaugugcacggacaccuaccuggauaccccgcggcccgacgacggcagcaucaccgggcccugcgaguccaacggcgacaagggcagugggggcaucaagggcggguucgugcaccagcgcauggccuccaagaucgggcggugguacagccgcacgauguccaagaccgagcggaagggcaugggccucuacgucaaguacgauggggaccccuggaccgacagcgacgcccuggcguuccgcggcgugaugguguccaugaaggagccggggugguacaguuucggcuucgagaucaaggacaagaagugcgacguccccugcaucgggaucgagauggugcaugacggcggcaaggagaccuggcacuccgccgccacggccaucuacugccugauggggagcggccagcuccugugggacaccgugaccggggucgacauggcccuguga

SEQ ID NO: 29069 - RNA, 1401 nt, Artificial Sequence
  derived and/or modified CDS sequence (AUadapt) from InfluenzaB__AFF18545__NA
augcugcccaguaccauccagaugcucacccuguuccugacguccggcggggugcuccugagccuguacgucuccgccagccucuccuaccugcuguacagugacauccuccugaaguucuccccgaccgagaucaccgcccccaccaugccccuggacugcgcgaacgccagcaacgugcaugccgugaaccgcuccgccacgaagggcgucaccuuccuccugcccgagccggaguggaccuacccccggcugagcugccccggguccaccuuccagaaggcccuccugaucucgccccaucgcuucggcgagacgaaggggaacuccgcgccgcugaucauccgggagcccuucaucgccugcggccccaacgagugcaagcacuuugcccucacccacuacgccgcgcagcccggcggguacuacaacggcacccgcggggaccggaacaagcugcgccaucugaucagcgugaagcucggcaagaucccgaccguggagaacuccaucuuccacauggccgccuggagcggguccgccugccacgauggcaaggaguggacguacaucggcgucgacgggcccgacaacaacgcccugcugaagaucaaguacggcgaggcguacaccgauaccuaccacucguacgccaacaacauccuccggacccaggaguccgccugcaauugcaucgggggcaacugcuaccugaugaucacggacggcagcgccagcgggguguccgagugucgcuuccugaagauccgggagggccgcaucaucaaggagaucuuccccaccgggcgggugaagcacaccgaggagugcacgugcggcuucgccucgaauaagaccaucgagugcgcgugccgcgacaacuccuacaccgccaagcggcccuucgucaagcucaacguggagaccgauaccgccgagauccgccugaugugcacggacaccuaccuggacaccccgcggcccgacgacgggagcaucaccggccccugugaguccaacggcgacaaggggagcggcgggaucaagggcggguucgugcaccagcgcauggccuccaagaucggccggugguacucgcgcacgauguccaagaccgagcggaagggcauggggcucuaugucaaguacgacggcgaccccuggaccgacagcgacgcccuggcguuccgcggggugaugguguccaugaaggagccgggcugguauagcuucggguucgagaucaaggacaagaagugcgacguccccugcaucggcaucgagauggugcaugacggcgggaaggagaccuggcacuccgccgccacggccaucuacugccugaugggcagcgggcagcuccugugggacaccgugaccggcgucgacauggcccuguga

SEQ ID NO: 29070 - RNA, 1401 nt, Artificial Sequence; identical to SEQ ID NO: 28686
  derived and/or modified CDS sequence (AUadapt) from InfluenzaB__AFH34933__NA

SEQ ID NO: 29071 - RNA, 1401 nt, Artificial Sequence; identical to SEQ ID NO: 28686
  derived and/or modified CDS sequence (AUadapt) from InfluenzaB__AFH34939__NA

SEQ ID NO: 29072 - RNA, 1401 nt, Artificial Sequence; identical to SEQ ID NO: 28868
  derived and/or modified CDS sequence (AUadapt) from InfluenzaB__AFH57869__NA

SEQ ID NO: 29073 - RNA, 1401 nt, Artificial Sequence
  derived and/or modified CDS sequence (AUadapt) from InfluenzaB__AFH57891__NA
augcugcccaguaccauccagacccucacgcuguuccugaccuccggcggggugcuccugagccuguacgucuccgccagccucuccuaccugcuguacagugacauccuccugaaguucucccagaccgagaucaccgccccgaucaugccccuggacuacgcgaacgccagcaaugugcaggccgugaaccacuccgccgccaagggcgucacgcuccugcugcccgagcccgaguggaccuacccgcgccucagcugccccggguccaccuuccagaaggcgcugcugaucaguccccaccgguucggcgagaccaaggggaacuccgcgccccucaucauccgcgagccguucaucgccugcggccccacggagugcaagcauuucgcccugacccacuacgccgcccagcccggcggguacuacaacggcacccgggaggaucgcaacaagcugcggcaccucaucucggugaagcuggggaagauccccaccguggagaacuccaucuuccacauggccgccuggaguggcuccgccugccacgacgggaaggaguggacguacaucggcgucgacggcccggacaguaacgcgcugcucaagaucaaguacggggaggccuacaccgacaccuaccacuccuaugccaagaacauccugcgcacccaggagagcgccugcaacugcaucggcggggacuguuaccugaugaucacggacggccccgccucgggcaucuccgagugccgguuccucaagauccgcgaggggcggaucaucaaggagaucuuccccaccggccgcgugaagcauaccgaggagugcacgugcggguucgcgagcaacaagaccaucgagugcgccugucgggacaacuccuacaccgccaagcgccccuucgugaagcugaacgucgagaccgacaccgccgagauccggcugauguguacggagaccuaccucgacaccccgcgccccaacgacggcagcaucaccgggcccugcgaguccgauggcgacaagggcagcgggggcaucaagggcggguucgugcaccagcggauggccuccaagaucgggcgcugguacucgcggacgauguccaagaccaagcgcaugggcaugggccuguaugugaaguacgacggggaccccuggaccgacagcgaggcgcuggcccucuccggcgucauggugagcauggaggagccggggugguauuccuucggcuucgagaucaaggacaagaagugcgacgugcccugcaucgggaucgagaugguccaugacggcggcaagaccacguggcacagcgccgccaccgccaucuacugccugaugggguccggccagcugcucugggacaccgugaccgggguggacauggcgcuguga

SEQ ID NO: 29074 - RNA, 1401 nt, Artificial Sequence; identical to SEQ ID NO: 28640
  derived and/or modified CDS sequence (AUadapt) from InfluenzaB__AFH57913__NA

SEQ ID NO: 29075 - RNA, 1401 nt, Artificial Sequence; identical to SEQ ID NO: 28686
  derived and/or modified CDS sequence (AUadapt) from InfluenzaB__AFH57935__NA

SEQ ID NO: 29076 - RNA, 1401 nt, Artificial Sequence; identical to SEQ ID NO: 28686
  derived and/or modified CDS sequence (AUadapt) from InfluenzaB__AFH57946__NA

SEQ ID NO: 29077 - RNA, 1401 nt, Artificial Sequence; identical to SEQ ID NO: 28686
  derived and/or modified CDS sequence (AUadapt) from InfluenzaB__AFH57957__NA

SEQ ID NO: 29078 - RNA, 1401 nt, Artificial Sequence; identical to SEQ ID NO: 28662
  derived and/or modified CDS sequence (AUadapt) from InfluenzaB__AFH57968__NA

SEQ ID NO: 29079 - RNA, 1401 nt, Artificial Sequence
  derived and/or modified CDS sequence (AUadapt) from InfluenzaB__AFH57979__NA
augcugcccaguaccauccagacccucacgcuguuccugaccuccggcggggugcuccugagccuguacgucuccgcccuccugagcuaccugcucuacuccgauauccugcugaaguucagcccgaccgagaucaccgcccccacgaugucccucgacugcgcgaacgccagcaacgugcaggccgugaaucgcuccgccaccaagggcgucaucuuccugcugcccgagcccgaguggaccuacccgcggcucagcugccccggguccaccuuccagaaggcccugcugaucucgccccaccgcuuuggcgagacgaaggggaacuccgcgccccucaucauccgggagccguucaucgccugcggccccaacgagugcaagcacuucgcccugacccauuacgccgcgcagcccggcggguacuacaacggcacccgcggggaccggaacaagcugcgccaccucaucagugugaagcugggcaagauccccaccguggagaacuccaucuuccacauggccgccuggagcggguccgccugccacgauggcaaggaguggacguacaucggcgucgacgggccggacaacgacgcccugcucaaggugaaguacggcgaggcguacaccgauaccuaccacagcuacgccaacaagauccugcggacccaggaguccgccugcaacuguaucgggggcaacugcuaccugaugaucacggacggcagcgccagcgggguguccgagugccgcuuucucaagauccgggagggccgcaucaucaaggagaucuuccccaccgggcgggucaagcacaccgaggagugcacgugcggcuucgccucgaacaagaccaucgagugugcgugccgcgacaacuccuacaccgccaagcggcccuucgugaagcugaacguggagaccgauaccgccgagauccgccugaugugcacggacaccuaccucgacacgccccggccggacgacgggagcaucaccggccccugugaguccaacggcgacaaggggagcggcgggaucaagggcggguucguccaccagcgcauggaguccaagaucggccggugguacagccgcaccauguccaagaccgagcggaugggcauggggcuguaugugaaguacgacggcgaccccugggccgacagcgacgcccuggcguucuccggggugauggucaguaugaaggagcccggcugguacuccuucggguucgagaucaaggacaagaagugcgacgugccgugcaucggcaucgagauggugcaugacggcgggaaggagaccuggcacagcgccgccaccgccaucuacugccucaugggcuccgggcagcugcugugggacacggucaccggcguggacauggcccucuga

SEQ ID NO: 29080 - RNA, 1401 nt, Artificial Sequence; identical to SEQ ID NO: 28697
  derived and/or modified CDS sequence (AUadapt) from InfluenzaB__AFH58253__NA

SEQ ID NO: 29081 - RNA, 1401 nt, Artificial Sequence; identical to SEQ ID NO: 28760
  derived and/or modified CDS sequence (AUadapt) from InfluenzaB__AFH58264__NA

SEQ ID NO: 29082 - RNA, 1401 nt, Artificial Sequence; identical to SEQ ID NO: 28901
  derived and/or modified CDS sequence (AUadapt) from InfluenzaB__AFH58275__NA

SEQ ID NO: 29083 - RNA, 1401 nt, Artificial Sequence; identical to SEQ ID NO: 28901
  derived and/or modified CDS sequence (AUadapt) from InfluenzaB__AFH58286__NA

SEQ ID NO: 29084 - RNA, 1401 nt, Artificial Sequence; identical to SEQ ID NO: 28640
  derived and/or modified CDS sequence (AUadapt) from InfluenzaB__AFH58297__NA

SEQ ID NO: 29085 - RNA, 1401 nt, Artificial Sequence
  derived and/or modified CDS sequence (AUadapt) from InfluenzaB__AFH58308__NA
augcugcccaguaccauccagacccucacgcuguuccugaccuccggcggggugcuccugagccuguacgucuccgccagccucuccuaucugcuguacagcgacauccuccugaaguucucccgcaccgagaccacggccccgaucaugccccuggacugugcgaacgccagcaacgugcaggccgugaaccgguccgccaccaagggcgucacccuccugcugcccgagcccgaguggaccuacccgcgccucaguugccccggguccacguuccagaaggcccugcugaucucgccccaccgguucggcgagaccaaggggaauuccgcgccccucaucauccgcgagccguucaucgccugcggccccaaggagugcaagcacuucgcccugacccauuacgccgcgcagcccggcggguacuacaacggcacccgggaggaccgcaauaagcugcggcaccucaucagcgugaagcuggggaagauccccacgguggagaacuccaucuuccacauggccgccuggaguggcuccgccugccacgacgggcgcgaguggaccuacaucggcgucgacggcccggauagcaacgcccugcucaagaucaaguacggggaggcguacaccgacaccuaucacuccuacgccaagaacauccugcggacgcaggagagcgccugcaauugcaucggcggggacugcuaccugaugaucaccgacggccccgccaguggcaucuccgagugccgcuuccucaagauccgggaggggcgcaucaucaaggagaucuuccccaccggccgggugaagcacaccgaggagugcacguguggguucgccucgaacaagaccaucgagugcgcgugccgcgauaacuccuacaccgccaagcggcccuucgugaagcugaacgucgagaccgacacggccgagauccgccugauguguaccgagaccuaccucgacaccccgcggcccaacgacggcagcaucacggggcccugugaguccaacggcgacaagggcagcgggggcaucaagggcggguucgugcaccagcgcauggccuccaagaucgggcggugguauagccgcaccauguccaagaccaagcggaugggcaugggccuguacgugaaguacgacggggaccccuggaccgauagcgaggcccuggcgcucuccggcgucauggugagcauggaggagccggggugguacuccuucggcuucgagaucaaggauaagaagugcgacgugcccugcaucgggaucgagaugguccacgacggcggcaagacgaccuggcauagcgccgccaccgccaucuacugccugaugggguccggccagcugcucugggacaccgugacggggguggacauggcccuguga

SEQ ID NO: 29086 - RNA, 1401 nt, Artificial Sequence; identical to SEQ ID NO: 29085
  derived and/or modified CDS sequence (AUadapt) from InfluenzaB__AFH58319__NA

SEQ ID NO: 29087 - RNA, 1401 nt, Artificial Sequence
  derived and/or modified CDS sequence (AUadapt) from InfluenzaB__AFH58341__NA
augcugcccaguaccauccagacccucacgcuguuccugaccuccggcggggugcuccugagccuguacgucuccgccagccucuccuaccugcuguauagcgacauccuccugaaguucucccgcaccgagaucaccgccccgaucaugccccuggacugcgcgaaugccagcaacgugcaggccgugaaccgguccgccacgaagggcgucacccuccugcugcccgagcccgaguggaccuacccgcgccucagcugucccggguccaccuuccagaaggcccugcugaucucgccccaccgguucggcgagacgaaggggaacuccgcgccccucaucauccgcgagccguucaucgccuguggccccaaggagugcaagcacuucgcccugacccacuacgccgcgcagcccggcggguauuacaacggcacccgggaggaccgcaacaagcugcggcaccucaucagugugcgccuggggaagauccccaccguggagaacuccaucuuccacauggccgccuggagcggcuccgccugccaugacgggcgggaguggacguacaucggcgucgacggcccggacagcaacgcccugcucaagaucaaguauggggaggcguacaccgacaccuaccacuccuacgccaagaauauccugcgcacccaggagagcgccugcaacugcaucggcggggacuguuaccugaugaucacggacggccccgccagcggcaucuccgagugccgguuccucaagauccgcgaggggcggaucaucaaggagaucuuucccaccggccgcgugaagcacaccgaggagugcacgugcggguucgccucgaacaagaccaucgagugugcgugccgggacaacuccuacaccgccaagcgccccuucgugaagcugaaugucgagaccgacaccgccgagauccggcugaugugcacggagaccuaccucgacaccccgcgccccaacgauggcagcaucaccgggcccugcgaguccaacggcgacaagggcagcgggggcaucaagggcggguuugugcaccagcggauggccuccaagaucgggcgcugguacagccggacgauguccaagaccaagcgcaugggcaugggccuguacgugaaguacgacggggaucccuggaccgacagcgaggcccuggcgcucuccggcgucauggugagcauggaggagccggggugguacuccuucggcuuugagaucaaggacaagaagugcgacgugcccugcaucgggaucgagaugguccacgauggcggcaagaccacguggcacagcgccgccaccgccaucuacugccugaugggguccggccagcugcucugggacaccgugaccggggugaacaugacgcuguga

SEQ ID NO: 29088 - RNA, 1401 nt, Artificial Sequence
  derived and/or modified CDS sequence (AUadapt) from InfluenzaB__AFH58363__NA
augcugcccaguaccauccagacccucacgcuguuccugaccuccggcggggugcuccugagccuguacgucuccgccagccucuccuaccugcuguacagugacauccuccugaaguucccguccaccgagaucaccgcccccacgaugccccuggacugcgcgaacgccagcaaugugcaggccgugaaccgcuccgccaccaagggcgucaccuuccuccugcccgagccggaguggaccuacccccggcugagcugccccggguccacguuccagaaggcccuccugaucaguccccaccgcuucggcgagaccaaggggaacuccgcgccgcugaucauccgggagcccuucaucgccugcggccccaaggagugcaagcauuucgcccucacccacuacgccgcgcagcccggcggguacuacaacggcacccgcggggaccggaauaagcugcgccaccugaucucggugaagcucggcaagaucccgacgguggagaacuccaucuuccacauggccgccuggagcggguccgccugucacgacggcaaggaguggaccuacaucggcgucgacgggcccgacaacaaugcccugcugaagaucaaguacggcgaggcguacaccgacaccuaccacagcuaugccaacaacauccuccggacgcaggaguccgccugcaacugcaucgggggcaacugcuaucugaugaucaccgacggcagcgccucggggguguccgagugccgcuuccugaagauccgggagggccgcaucaucaaggagaucuuccccaccgggcggaucaagcauaccgaggagugcacgugcggcuucgccagcaacaagaccaucgagugcgcgugucgcgacaacuccuacaccgccaagcggcccuucgugaagcucaacgucgagaccgacacggccgagauccgccugauguguaccgagaccuaccuggacaccccgcggcccgacgacgggagcaucacgggccccugcgaguccaacggcgggaagggcagugggggcaucaagggcggguucgugcaccagcgcauggccuccaagaucggccggugguacucgcgcaccauguccaagaccgagcggaaggggaugggccucuacgugaaguacgauggggaccccugggccgacagcgacgcgcuggccuucuccggcgucauggugagcauggaggagccggggugguauuccuucggcuucgagaucaaggacaagaagugcgacgugcccugcaucggcaucgagaugguccaugacgggggcaaggagaccuggcacagcgccgccacggccaucuacugccugaugggguccggccagcuccugugggacaccgugaccggcgugaacauggcgcuguga

SEQ ID NO: 29089 - RNA, 1401 nt, Artificial Sequence; identical to SEQ ID NO: 29088
  derived and/or modified CDS sequence (AUadapt) from InfluenzaB__AFH58374__NA

SEQ ID NO: 29090 - RNA, 1401 nt, Artificial Sequence; identical to SEQ ID NO: 28640
  derived and/or modified CDS sequence (AUadapt) from InfluenzaB__AFH58385__NA

SEQ ID NO: 29091 - RNA, 1401 nt, Artificial Sequence; identical to SEQ ID NO: 28640
  derived and/or modified CDS sequence (AUadapt) from InfluenzaB__AFH58396__NA

SEQ ID NO: 29092 - RNA, 1401 nt, Artificial Sequence; identical to SEQ ID NO: 28640
  derived and/or modified CDS sequence (AUadapt) from InfluenzaB__AFH58407__NA

SEQ ID NO: 29093 - RNA, 1401 nt, Artificial Sequence; identical to SEQ ID NO: 28640
  derived and/or modified CDS sequence (AUadapt) from InfluenzaB__AFH58418__NA

SEQ ID NO: 29094 - RNA, 1401 nt, Artificial Sequence
  derived and/or modified CDS sequence (AUadapt) from InfluenzaB__AFH58429__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaacgaguguaagcacuucgcccugacccacuacgccgcgcagcccggcggguacuacaauggcacccgcggggaccggaacaagcugcgccaccucaucagcgugaagcugggcaagaucccgacgguggagaacuccaucuuccauauggccgccuggagcggguccgccugccacgacggcaaggaguggaccuacaucggcgucgacgggcccgauaacaacgcccugcucaaggugaaguacggcgaggcguacaccgacaccuaccauucguacgccaacaagauccugcggacgcaggaguccgccugcaacugcaucgggggcaauugcuaccugaugaucaccgacggcagcgccagcgggguguccgagugucgcuuccucaagauccgggagggccgcaucaucaaggagaucuuccccaccgggcgggucaagcacaccgaggagugcacgugcggcuucgccaguaacgagaccaucgagugcgcgugccgcgacaacuccuacaccgccaagcggcccuuugugaagcugaacguggagaccgacacggccgagauccgccugaugugcaccgacaccuaccucgacaccccgcggcccaaugacgggagcaucacgggccccugcgaguccaacggcgacaaggggucgggcgggaucaagggcggguuuguccaccagcgcauggaguccaagaucggccggugguacagccgcaccauguccaagaccgagcggaugggcauggggcuguacgugaaguacgacggcgaucccugggccgacagcgacgcccuggcguucuccggggugauggucagcaugaaggagccgggcugguacuccuuuggguucgagaucaaggacaagaagugcgacgugcccugcaucggcaucgagauggugcacgauggcgggaaggagaccuggcacagcgccgccacggccaucuacugccucaugggcuccgggcagcugcugugggacaccgucaccggcguggacauggcccucuga

SEQ ID NO: 29095 - RNA, 1401 nt, Artificial Sequence
  derived and/or modified CDS sequence (AUadapt) from InfluenzaB__AFH58440__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaacgugcaggccgugaaucgcuccgccaccaagggcgucacccuccugcugcccgagccggaguggaccuacccccggcucagcugccccggguccacguuccagaaggcccugcugaucucgccccaccgcuucggcgagaccaaggggaauuccgcgccgcucaucauccgggagcccuucaucgccugcggccccaacgagugcaagcacuucgcccugacccacuaugccgcgcagcccggcggguacuacaacggcacccgcggggaccggaacaagcugcgccaccucaucagugugaagcugggcaagaucccgacgguggagaacuccaucuuccacauggccgccuggagcggguccgccugccacgacggcaaggaguggaccuauaucggcgucgacgggcccgacaacaacgcccugcucaaggugaaguacggcgaggcguacaccgacaccuaucacucguacgccaacaagauccugcggacgcaggaguccgccugcaacugcaucgggggcaauugcuaccugaugaucaccgacggcagcgccagcgggguguccgagugccgcuuucucaagauccaggagggccggaucaucaaggagaucuuccccaccgggcgcgucaagcacaccgaggagugcacgugcggcuucgccucgaacaagaccaucgagugugcgugccgggacaacuccuacaccgccaagcgccccuucgugaagcugaacguggagaccgacacggccgagauccggcugauguguaccgacaccuaccucgacaccccgcgccccaacgacgggagcaucacgggccccugcgaguccaauggcgacaaggggagcggcgggaucaagggcggguucguccaccagcggauggaguccaagaucggccgcugguacucgcggaccauguccaagaccgagcgcaugggcauggggcuguaugugaaguacgacggcgaccccugggccgacagcgacgcccuggcguucuccggggugauggucaguaugaaggagccgggcugguacuccuucggguucgagaucaaggacaagaagugcgacgugcccugcaucggcaucgagauggugcaugacggcgggaaggagaccuggcacagcgccgccacggccaucuacugccucaugggcuccgggcagcugcugugggacaccgucaccggcguggacauggcccucuga

SEQ ID NO: 29096 - RNA, 1401 nt, Artificial Sequence; identical to SEQ ID NO: 28649
  derived and/or modified CDS sequence (AUadapt) from InfluenzaB__AFH58462__NA

SEQ ID NO: 29097 - RNA, 1401 nt, Artificial Sequence; identical to SEQ ID NO: 28649
  derived and/or modified CDS sequence (AUadapt) from InfluenzaB__AFH58473__NA

SEQ ID NO: 29098 - RNA, 1401 nt, Artificial Sequence; identical to SEQ ID NO: 28686
  derived and/or modified CDS sequence (AUadapt) from InfluenzaB__AFH58484__NA

SEQ ID NO: 29099 - RNA, 1401 nt, Artificial Sequence; identical to SEQ ID NO: 28686
  derived and/or modified CDS sequence (AUadapt) from InfluenzaB__AFH58495__NA

SEQ ID NO: 29100 - RNA, 1401 nt, Artificial Sequence; identical to SEQ ID NO: 28686
  derived and/or modified CDS sequence (AUadapt) from InfluenzaB__AFH58506__NA

SEQ ID NO: 29101 - RNA, 1401 nt, Artificial Sequence
  derived and/or modified CDS sequence (AUadapt) from InfluenzaB__AFH58517__NA
augcugcccaguaccauccagacccucacgcuguuccugaccuccggcggggugcuccugagccuguacgucuccgcccuccugagcuaccugcucuauuccgacauccugcugaaguucagcccgaccgagaucaccgcccccacgaugucccucgacugcgcgaacgccaguaacgugcaggccgugaaccgcuccgccaccaagggcgucaccuuccugcugcccgagcccgaguggaccuacccgcggcucagcugccccggguccacguuucagaaggcccugcugaucagcccccaccgcuucggcgagaccaaggggaacuccgcgccccucaucauccgggagccguucaucgccugcggccccaaugagugcaagcacuucgcccugacccacuacgccgcgcagcccggcggguacuauaacggcacccgcggggaccggaacaagcugcgccaccucaucagcgugaagcugggcaagauccccacgguggagaacuccaucuuucacauggccgccuggagcggguccgccugccacgacggcaaggaguggaccuacaucggcgucgaugggccggacaacgacgcccugcucaaggugaaguacggcgaggcguacaccgacaccuaucacucguacgccaacaagauccugcggacgcaggaguccgccugcaacuguaucgggggcaacugcuaccugaugaucaccgacggcagcgccagcgggguguccgagugucgcuuccucaagauccgggagggccgcaucaucaaggagaucuuccccaccgggcgggucaagcacaccgaggagugcacgugcggcuucgccaguaacaagaccaucgagugcgcgugccgcgacaacuccuacaccgccaagcggcccuuugugaagcugaacguggagaccgacacggccgagauccgccugaugugcaccgacaccuaccucgacacgccccggccggaugacgggagcaucaccggccccugcgaguccaacggcgacaaggggagcggcgggaucaagggcggguuuguccaccagcgcauggaguccaagaucggccggugguacagccgcaccauguccaagaccgagcggaugggcauggggcuguacgugaaguacgacggcgaucccugggccgacagcgacgcccuggcguucuccggggugauggucagcaugaaggagcccggcugguacuccuuuggguucgagaucaaggacaagaagugcgacgugccgugcaucggcaucgagauggugcacgauggcgggaaggagaccuggcacagcgccgccacggccaucuacugccucaugggcuccgggcgccugcugugggacaccgucaccggcguggacauggcccucuga

SEQ ID NO: 29102 - RNA, 1401 nt, Artificial Sequence; identical to SEQ ID NO: 28662
  derived and/or modified CDS sequence (AUadapt) from InfluenzaB__AFH58528__NA

SEQ ID NO: 29103 - RNA, 1401 nt, Artificial Sequence
  derived and/or modified CDS sequence (AUadapt) from InfluenzaB__AFH58539__NA
augcugcccaguaccgugcagacccucacgcugcugcucaccuccggcgggguccugcugagccucuacguguccgccucgcuguccuaccugcucuacagugacgugcugcugaaguucuccagcaccaagaccacggccccgaccaugucccucgagugcaccaacgcgucgaaugcccagaccgucaaccacuccgccacgaaggagaugaccuucccgccgcccgagcccgaguggaccuacccccgccugagcugucagggcuccaccuuccagaaggcccugcucaucagcccccaccgguucggggagaucaagggcaacuccgcgccccugaucauccgcgagcccuucguggccugugggcccaaggagugccggcacuucgcccugacgcacuacgccgcccagcccggcggcuauuacaacgggacccgcaaggaccggaacaagcuccgccaccuggugucggucaagcugggcaagauccccaccguggagaauuccaucuuccacauggcggccuggagcggguccgccugccacgauggccgggaguggaccuacaucgggguggacggcccggacaacgacgcccucgucaagaucaaguacggcgaggccuauacggacaccuaccacagcuacgcgcauaacauccugcgcacccaggagucggccugcaacugcaucgggggcgacuguuaccugaugaucaccgacggguccgccagcggcaucuccaagugccgguuccucaagauccgcgagggccggaucaucaaggagauccugcccacggggcgcguggagcauaccgaggagugcacgugcggcuucgccagcaacaagaccaucgagugcgccugucgggacaacuccuacaccgcgaagcgccccuucgugaagcugaacgucgagaccgauaccgccgagauccggcucaugugcaccaagacguaccuggacacgccccgcccggacgacgggucgaucgccggccccugugaguccaacggggacaaguggcugggcggcaucaagggcggguucgugcaccagcggauggccagcaagaucgggcgcugguauucccggaccaugagcaagaccaaccgcaugggcauggagcucuacgugaaguacgacggggaccccuggaccgauuccgacgcccugacccugucgggcgucaugguguccaucgaggagcccggcugguacagcuucggguuugagaucaaggacaagaagugcgacgugccgugcaucggcaucgagaugguccacgacgggggcaaggauaccuggcacuccgcggccaccgccaucuacugccucauggggagcggccagcugcugugggacacggccaccggcguggacauggcccucuga

SEQ ID NO: 29104 - RNA, 1401 nt, Artificial Sequence
  derived and/or modified CDS sequence (AUadapt) from InfluenzaB__AFH58550__NA
augcugcccaguaccauccagacccucacgcuguuccugaccuccggcggggugcuccugagccuguacgucuccgccagccucuccuaucugcuguacagcgacauccuccugaaguucuccccgaccgagaucaccgcccccacgaugccccuggacugugcgaacgccucgaacgugcaggccgugaaccgcuccgccaccaaggagaugacccuccugcugcccgagccggaguggaccuacccccggcucaguugccccggcuccacguuccagaaggcccugcugaucagcccccaccgcuuuggggagacccggggcaacuccgcgccgcucaccauccgcgagcccuucaucgccugcgggcccaaggagugcaagcacuuugcccugacccacuacgccgcgcagcccggcggcuacuacaacgggacgcgggaggaucgcaacaagcugcggcaccucaucagcgucaagcugggcaagaucccgaccguggagaacuccaucuuccauauggccgccuggagcggguccgccugccacgacggccgcgaguggaccuauaucgggguggacggccccgacucgaacgcccugaucaagaucaaguacggcgaggcguauaccgacacguaccacuccuacgccaacaauauccuccggacccaggagagcgccugcaacugcaucgggggcgauugcuaccugaugaucaccgacgggagcgccuccggcaucagcaagugucgcuuccugaagauccgggagggccgcaucaucaaggagaucuuccccaccgggcgggucgagcacacggaggagugcacgugcggcuuugccuccaacaagaccaucgagugcgcgugccgcgacaacaguuacaccgccaagcggcccuucgugaagcucaacguggagaccgacaccgccgagauccgccugauguguaccgagaccuaccuggacacgccgcggcccgacgacggguccaucaccggccccugcgagaguaacggggacaagggccgcggcgggaucaagggcggguucguccaccagcggauggccuccaagaucggccgcugguacagucggaccauguccaagaccgagcgcauggggauggagcucuacgugaaguacgacggcgaccccuggacggauagcgaggcccuggcgccguccggcgugauggucagcauggaggagcccgggugguacuccuucggcuucgagaucaaggauaagaagugcgacgugcccugcaucgggaucgagauggugcacgacggcgggaagaagaccuggcauagcgccgccaccgccaucuacugccugaugggcuccggccagcuccugugggacaccgucacggggguggacauggcccuguga

SEQ ID NO: 29105 - RNA, 1401 nt, Artificial Sequence; identical to SEQ ID NO: 29104
  derived and/or modified CDS sequence (AUadapt) from InfluenzaB__AFH58561__NA

SEQ ID NO: 29106 - RNA, 1401 nt, Artificial Sequence
  derived and/or modified CDS sequence (AUadapt) from InfluenzaB__AFJ69969__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaacgugcaggccgugaaucgcuccgccaccaagggcgucacccuccugcugcccgagccggaguggaccuacccccggcucagcugccccggguccacguuccagaaggcccugcugaucucgccccaccgcuucggcgagaccaaggggaauuccgcgccgcucaucauccgggagcccuucaucgccugcggccccaacgagugcaagcacuucgcccugacccacuaugccgcgcagcccggcggguacuacaacggcacccgcggggaccggaacaagcugcgccaccucaucagugugaagcugggcaagaucccgacgguggagaacuccaucuuccacauggccgccuggagcggguccgccugccacgacggcaaggaguggaccuauaucggcgucgacgggcccgacaacaacgcccugcucaaggugaaguacggcgaggcguacaccgacaccuaucacucguacgccaacaagauccugcggacgcaggaguccgccugcaacugcaucgggggcaauugcuaccugaugaucaccgacggcagcgccagcgggguguccgagugccgcuuucucaagauccgggagggccgcaucaucaaggagaucuuccccaccgggcgggucaagcacaccgaggagugcacgugcggcuucgccucgaacaagaccaucgagugugcgugccgcgacaacuccuacaccgccaagcggcccuucgugaagcugaacguggagaccgacacggccgagauccgccugauguguaccgacaccuaccucgacaccccgcggcccaacgacgggagcaucacgggccccugcgaguccaauggcgacaaggggagcggcgggaucaagggcggguucguccaccagcgcauggaguccaagaucggccggugguacucgcgcaccauguccaagaccgagcggaugggcauggggcuguaugugaaguacgacggcgaccccuggaccgacagcgacgcccuggccuucuccggggugauggucaguaugaaggagccgggcugguacuccuucggguucgagaucaaggacaagaagugcgacgugcccugcaucggcaucgagauggugcaugacggcgggaaggagacguggcacagcgcggccaccgccaucuacugccucaugggcuccgggcagcugcugugggacaccgucaccggcguggacauggcccucuga

SEQ ID NO: 29107 - RNA, 1401 nt, Artificial Sequence; identical to SEQ ID NO: 29069
  derived and/or modified CDS sequence (AUadapt) from InfluenzaB__AFJ69971__NA

SEQ ID NO: 29108 - RNA, 1401 nt, Artificial Sequence
  derived and/or modified CDS sequence (AUadapt) from InfluenzaB__AFJ69973__NA
augcugcccaguaccauccagaugcucacccuguuccugacguccggcggggugcuccugagccuguacgucuccgccagccucuccuaccugcuguacagugacauccuccugaaguucuccccgaccgagaucaccgcccccaccaugccccuggacugcgcgaacgccagcaaugugcacgccgugaaccgcuccgccacgaagggcgucaccuuccuccugcccgagccggaguggaccuacccccggcugagcugccccggguccaccuuccagaaggcccuccugaucaguccccaccgcuucggcgagacgaaggggaacuccgcgccgcugaucauccgggagcccuucaucgccugcggccccaacgaguguaagcacuucgcccucacccacuacgccgcgcagcccggcggguacuacaacggcacccgcggggaucggaacaagcugcgccaccugaucucggugaagcucggcaagaucccgaccguggagaacuccaucuuccacauggccgccuggaguggguccgccugccacgacggcaaggaguggacguacaucggcgucgacgggcccgacaacaaugcccugcugaagaucaaguacggcgaggcguacaccgacaccuaccacagcuaugccaacaacauccuccggacccaggaguccgccugcaacugcaucgggggcaacugcuaucugaugaucacggacggcagcgccucggggguguccgccugccgcuuccugaagauccgggagggccgcaucaucaaggagaucuuccccaccgggcgggugaagcauaccgaggagugcacgugcggcuucgcgagcaacaagaccaucgagugcgccugccgcgauaacuccuacaccgccaagcggcccuucgucaagcucaacguggagaccgacaccgccgagauccgccugaugugcacggauaccuaccuggacaccccgcggcccgacgacgggagcaucaccggccccugcgaguccaacggcgauaaggggagcggcgggaucaagggcggguucgugcaccagcgcauggccuccaagaucggccggugguacucgcgcacgauguccaagaccgagcggaagggcauggggcucuacgucaaguaugacggcgaccccuggaccgacagcgacgcgcuggccuuccgcggggugaugguguccaugaaggagccgggcugguacaguuucggguucgagaucaaggacaagaagugcgacguccccugcaucggcaucgagauggugcaugacggcgggaaggagaccuggcacuccgccgccacggccaucuacugccugaugggcagcgggcagcuccugugggacaccgugaccggcgucgacauggcgcuguga

SEQ ID NO: 29109 - RNA, 1401 nt, Artificial Sequence; identical to SEQ ID NO: 28686
  derived and/or modified CDS sequence (AUadapt) from InfluenzaB__AFJ69975__NA

SEQ ID NO: 29110 - RNA, 1401 nt, Artificial Sequence
  derived and/or modified CDS sequence (AUadapt) from InfluenzaB__AFJ69979__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacaccagcaacgugcaggccgugaaucacuccgccaccaagggcgucacccuccugcugcccgagccggaguggacguacccccgccucagcugccccggguccaccuuccagaaggcccugcugaucucgccccaccgguuuggcgagaccaaggggaacuccgccccgcucaucauccgcgagcccuucaucgcgugcggccccaacgagugcaagcacuucgcccugacccauuacgccgcccagcccggcggguacuacaacggcacgcgcggggaccggaacaagcugcggcaccucaucagugugaagcugggcaagaucccgaccguggagaacuccaucuuccacauggcggccuggagcggguccgccugccacgauggcaaggaguggaccuacaucggcgucgacgggcccgacaacaacgcccugcucaaggugaaguacggcgaggccuacaccgauacguaccacucguacgcgaacaagauccugcgcacccaggaguccgccugcaacuguaucgggggcaacugcuaccugaugaucaccgacggcagcgccagcgggguguccgagugccgguuucucaagauccgcgagggccggaucaucaaggagaucuuccccaccgggcgcgucaagcacacggaggagugcacgugcggcuucgccucgaacaagaccaucgagugugccugccgggacaacuccuacaccgcgaagcgccccuucgugaagcugaacguggagaccgauaccgccgagauccggcugaugugcaccgacaccuaccucgacacgccgcgccccgacgacgggagcaucaccggccccugugaguccaacggcgacaaggggagcggcgggaucaagggcggguucguccaccagcggauggaguccaagaucggccgcugguacucgcggaccauguccaagaccgagcgcaugggcauggggcuguaugugaaguacgacggcgaccccugggccgacagcgacgcccuggccuucuccggggugauggucaguaugaaggagccgggcugguacuccuucggguucgagaucaaggacaagaagugcgacgugcccugcaucggcaucgagauggugcaugacggcgggaaggagacguggcacagcgcggccaccgccaucuacugccucaugggcuccgggcagcugcugugggacaccgucaccggcguggacauggcccucuga

SEQ ID NO: 29111 - RNA, 1401 nt, Artificial Sequence; identical to SEQ ID NO: 29069
  derived and/or modified CDS sequence (AUadapt) from InfluenzaB__AFJ69981__NA

SEQ ID NO: 29112 - RNA, 1401 nt, Artificial Sequence
  derived and/or modified CDS sequence (AUadapt) from InfluenzaB__AFJ69983__NA
augcugcccaguaccauccagaugcucacccuguuccugacguccggcggggugcuccugagccuguacgucuccgccagccucuccuaccugcuguauucggacauccuccugaaguucuccccgaccgagaucaccgcccccaccaugccccuggacugcgcgaacgccaguaacgugcacgccgugaaccgcuccgccacgaagggcgucaccuuccuccugcccgagccggaguggaccuacccccggcugagcugucccggguccaccuuccagaaggcccuccugaucagcccccaccgcuucggcgagacgaaggggaacuccgcgccgcugaucauccgggagcccuucaucgccuguggccccaacgagugcaagcacuucgcccucacccacuacgccgcgcagcccggcggguauuacaacggcacccgcggggaccggaacaagcugcgccaccugaucucggugaagcucggcaagaucccgaccguggagaauuccaucuuccacauggccgccuggagcggguccgccugccacgacggcaaggaguggacguauaucggcgucgacgggcccgacaacaacgcccugcugaagaucaaguacggcgaggcguacaccgauaccuaccacagcuacgccaacaacauccuccggacccaggaguccgccuguaacugcaucgggggcaacugcuaccugaugaucacggacggcagugccucggggguguccgagugccgcuuccugaagauccgggagggccgcaucaucaaggagauccuccccaccgggcgggugaagcacaccgaggagugcacgugcggcuuugccagcaacaagaccaucgagugcgcgugccgcgacaacuccuauaccgccaagcggcccuucgucaagcugaacguggagaccgacaccgccgagauccgccugaugugcacggacaccuaccucgauaccccgcggcccgacgacgggagcaucaccggccccugcgaguccaacggcgggaagggcagcgggggcaucaagggcggguuugugcaccagcgcauggccuccaagaucggccggugguacucgcgcacgauguccaagaccgagcggaaggggaugggccuguacgucaaguacgacggggaucccuggaccgacagcgacgcccuggcguuccgcggcgugaugguguccaugaaggagccggggugguacagcuuuggcuucgagaucaaggacaagaagugcgacguccccugcaucggcaucgagauggugcacgaugggggcaaggagaccuggcacuccgccgccacggccaucuacugccucauggggagcggccagcugcugugggacaccgugaccggcgucgacauggcccucuga

SEQ ID NO: 29113 - RNA, 1401 nt, Artificial Sequence
  derived and/or modified CDS sequence (AUadapt) from InfluenzaB__AFJ69987__NA
augcugcccaguaccauccagacccucacgcuguuccugaccuccggcggggugcuccugagccuguacgucuccgccagccucuccuaccugcuguauucggacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaacgaguguaagcacuucgcccugacccacuacgccgcgcagcccggcggguacuacaauggcacccgcggggaccggaacaagcugcgccaccucaucagcgugaagcugggcaagaucccgacgguggagaacuccaucuuccauauggccgccuggagcggguccgccugccacgacggcaaggaguggaccuacaucggcgucgacgggcccgauaacaacgcccugcucaaggugaaguacggcgaggcguacaccgacaccuaccauucguacgccaacaagauccugcggacgcaggaguccgccugcaacugcaucgggggcaauugcuaccugaugaucaccgacggcagcgccagcgggguguccgagugucgcuuccucaagauccgggagggccgcaucaucaaggagaucuuccccaccgggcgggucaagcacaccgaggagugcacgugcggcuucgccaguaacaagaccaucgagugcgcgugccgcgacaaccgguacaccgccaagcgccccuuugugaagcugaacguggagaccgacacggccgagauccggcugaugugcaccgacaccuaccucgacaccccgcgccccaaugacggguccaucacgggccccugcgagagcgacggcgacaagggguccggcgggaccaagggcggguucguccaucagcggaugaaguccaagaucggccgcugguacagccggaccaugucgaagaccgagcgcaugggcauggggcuguacgugaaguacgacggcgaucccugggccgacuccgacgcccugacguucagcggggugauggucuccaugaaggagccgggcugguacagcuuuggguucgagaucaaggacaagaagugcgacgugcccugcaucggcaucgagauggugcacgauggcgggaaggagaccuggcacuccgcggccaccgccaucuacugccucaugggcagcgggcagcugcugugggacaccgucacgggcguggacauggcccucuga

SEQ ID NO: 29114 - RNA, 1401 nt, Artificial Sequence
  derived and/or modified CDS sequence (AUadapt) from InfluenzaB__AFJ76228__NA
augcugcccaguaccauccagacccucacgcuguuccugaccuccggcggggugcuccugagccuguacgucuccgccagccucuccuaccugcuguauagcggcauccuccugaaguucuccccgaccgagaucaccgcccccacgaugccccugaacugcgcgaacgccagcaaugugcaggccgugaaccgcuccgccaccaagggggucacccuccugcugcccgagccggaguggaccuacccccggcucucgugccccggcuccacguuccagaaggcccugcugaucagcccccaucgcuucggggagaccaagggcaacuccgcgccgcucaucauccgggagcccuucaucgccugcggccccaaggagugcaagcauuucgcccugacccacuacgccgcgcagcccgggggcuacuacaacgggacccgcgaggaucggaacaagcugcgccaccucaucagcgugaagcugggcaagaucccgacgguggagaacuccaucuuccacauggccgccuggaguggguccgccugccacgacggccgggaguggaccuacaucggcgucgacgggcccgacaguaacgcccugcucaagaucaaguacggcgaggcguacaccgacaccuaccauuccuacgccaacaacauccugcgcacgcaggagucggccugcaacuguaucgggggcgacugcuaccugaugaucaccgacggcagcgccuccgggaucagcgagugucgguuccucaagauccgcgagggccggaucaucaaggagaucuuccccaccgggcgcguggagcacaccgaggagugcacgugcggcuuugccuccaacaagaccaucgagugcgcgugccgggacaacagcuauaccgccaagcgccccuucgugaagcugaacgucgagaccgacacggccgagauccggcugaugugcaccgagaccuaccucgacaccccgcgccccgaugacggguccaucacgggccccugcgagagcaacggcgacaagggguccggcgggaucaagggcggguucgugcaucagcggauggccucgaagaucggccgcugguacucccggaccaugagcaagaccaagcgcaugggcauggggcuguacgugaaguacgauggcgaccccuggaucgacuccgacgcccugacccucagcggggucaugguguccauggaggagccgggcugguacagcuuuggguucgagaucaaggacaagaagugcgacgugcccugcaucggcaucgagaugguccacgauggcgggaagaagacguggcacuccgcggccaccgccaucuacugccugaugggcagcgggcagcugcucugggacaccgugaccggcguggacauggcccuguga

SEQ ID NO: 29115 - RNA, 1401 nt, Artificial Sequence; identical to SEQ ID NO: 28781
  derived and/or modified CDS sequence (AUadapt) from InfluenzaB__AFJ76261__NA

SEQ ID NO: 29116 - RNA, 1401 nt, Artificial Sequence
  derived and/or modified CDS sequence (AUadapt) from InfluenzaB__AFJ76283__NA
augcugcccaguaccauccagacccucacgcuguuccugaccuccggcggggugcuccugagccuguacgucuccgccagccucuccuaccugcuguacagugacauccuccugaaguucccgcccaccgagaucaccgcccccacgaugccccuggacugcgcgaacgccuccaacgugcaggccgugaaucgcagcgccaccaagggcgucacccuccugcugccggagcccgaguggaccuacccccggcucuccugccccgggagcacguuccagaaggcccugcugaucuccccgcaccgcuuuggcgagaccaaggggaacucggcgccccucaucauccgggagcccuucaucgccugcggccccaaggagugcaagcacuuugcccugacccacuacgccgcgcagccgggcggguacuacaacggcacccgcggggaccggaacaagcugcgccaucucaucuccgugaagcugggcaagauccccacgguggagaacagcaucuuccacauggccgccugguccgggagcgccugccaugacggcaaggaguggaccuacaucggcgucgacgggcccgacaacaacgcccugcucaagaucaaguauggcgaggcguacaccgacaccuaccacuccuacgccaacaauauccugcggacgcaggagucggccugcaacugcaucgggggcaacugcuaccugaugaucaccgauggcuccgccagcggggugagcgagugccgcuuccucaagauccgggagggccgcaucaucaaggagaucuuccccaccgggcggaucaagcacaccgaggaguguacgugcggcuucgccuccaacaagaccaucgagugcgcgugccgcgacaauucguacaccgccaagcggccguucgugaagcugaacgucgagaccgacacggccgagauccgccugaugugcaccgagaccuaucucgacacgccccggcccgacgacggguccaucaccggccccugcgagagcaacggcgacaagggguccggcgggaucaagggcggguuugugcaccagcgcauggccagcaagaucggccggugguacucccgcaccaugucgaagaccgagcggaugggcauggggcuguacgugaaguacgauggcgacccgugggccgacuccgacgcgcugaccuucagcggggucaugguguccauggaggagcccggcugguacaguuucggguucgagaucaaggacaagaagugcgacgugcccugcaucggcaucgagaugguccaugacggcgggaaggagacguggcacuccgccgccaccgccaucuacugccucaugggcagcgggcagcugcugugggacaccgugaccggcgugaacauggcccucuga

SEQ ID NO: 29117 - RNA, 1401 nt, Artificial Sequence
  derived and/or modified CDS sequence (AUadapt) from InfluenzaB__AFJ76305__NA
augcugcccaguaccauccagacccucacgcuguuccugaccuccggcggggugcuccugagccuguacgucuccgccagccucuccuaccugcuguauagcgacauccuccugaaguucccguccaccgagaucaccgcccccacgaugccccuggacugcgcgaaugccagcaacgugcaggccgugaaccgcuccgccaccaagggcgucacccuccugcugcccgagccggaguggaccuacccccggcucagcugccccggguccacguuucagcgcgcccugcugaucucgccccaccgguucggcgagaccaaggggaacuccgcgccgcucaucauccgcgagcccuucaucgccuguggccccaaggagugcaagcacuucgcccugacccacuacgccgcgcagcccggcggguacuauaacggcacccgcggggaccggaacaagcugcggcaccucaucagcgugaagcugggcaagaucccgacgguggagaauuccaucuuccacauggccgccuggagcggguccgccugccacgacggcaaggaguggaccuauaucggcgucgacgggcccgacaacaacgcccugcucaagaucaaguacggcgaggcguauaccgacaccuaccacagcuacgccaacaauauccugcgcacgcaggaguccgccugcaacugcaucgggggcaacugcuaucugaugaucaccgacggcagcgccagcgggguguccgagugccgguuccucaagauccgcgagggccggaucaucaaggagaucuuccccaccgggcgcaucaagcauaccgaggagugcacgugcggcuucgccucgaacaagaccaucgagugugcgugccgggacaacuccuacaccgccaagcgccccuucgugaagcugaacgucgagaccgauacggccgagauccggcugaugugcaccgagaccuaccucgacaccccgcgccccgacgacgggaguaucacgggccccugcgaguccaacggcgacaaggggagcggcgggaucaagggcggguucgugcaccagcggauggccuccaagaucggccgcugguauagccggaccauguccaagaccgagcgcaugggcauggggcuguacgugaaguacgacggcgaccccugggccgauagcgacgcgcugaccuucuccggggucauggugagcauggaggagccgggcugguacuccuucggguuugagaucaaggacaagaagugcgacgugcccugcaucggcaucgagaugguccacgauggcgggaaggagacguggcacagcgccgccaccgccaucuacugccucaugggcuccgggcagcugcugugggacaccgugaccggcguggacauggcccucuga

SEQ ID NO: 29118 - RNA, 1401 nt, Artificial Sequence
  derived and/or modified CDS sequence (AUadapt) from InfluenzaB__AFJ76316__NA
augcugcccaguaccauccagacccucacgcuguuccugaccuccggcggggugcuccugagccuguacgucuccgccagccucuccuaccugcuguacagugacauccuccugaaguucccguccaccgagaucaccgcccccacgaugccccuggacugcgcgaacgccagcaacgugcaggccgugaaucgcuccgccaccaagggcgucacccuccugcugcccgagccggaguggaccuacccccggcucagcugccccggguccacguuccagaaggcccugcugaucucgccccaccgcuucggcgagaccaaggggaauuccgcgccgcucaucauccgggagcccuucaucgccugcggccccaaggagugcaagcacuucgcccugacccacuaugccgcgcagcccggcggguacuacaacggcacccgcggggaccggaacaagcugcgccaccucaucagcgugaagcugggcaagaucccgacgguggagaauuccaucuuccacauggccgccuggagcggguccgccugccacgacggcaaggaguggaccuacaucggcgucgaugggcccgacaacaacgcccugcucaagaucaaguacggcgaggcguacaccgacaccuaucacucguacgccaacaacauccugcggacgcaggaguccgccugcaacuguaucgggggcaacugcuaccugaugaucaccgacggcagcgccagcgggguguccgagugccgcuuucucaagauccgggagggccgcaucaucaaggagaucuuccccaccgggcggaucaagcacaccgaggagugcacgugcggcuucgccucgaauaagaccaucgagugcgcgugccgcgacaacuccuacaccgccaagcggcccuucgugaagcugaacgucgagaccgauacggccgagauccgccugaugugcaccgagaccuaccucgacaccccgcggcccgacgacgggagcaucacgggccccugcgaguccaauggcgacaaggggagcggcgggaucaagggcggguucgugcaccagcgcauggccuccaagaucggccggugguacucgcgcaccauguccaagaccgagcggaugggcauggggcuguaugugaaguacgacggcgaccccugggccgacagcgacgcgcugaccuucuccggggucauggugaguauggaggagccgggcugguacuccuucggguucgagaucaaggacaagaagugcgacgugcccugcaucggcaucgagaugguccaugacggcgggaaggagacguggcacagcgccgccaccgccaucuacugccucaugggcuccgggcagcugcugugggacaccgugaccggcgugaacauggcccucuga

SEQ ID NO: 29119 - RNA, 1401 nt, Artificial Sequence; identical to SEQ ID NO: 28781
  derived and/or modified CDS sequence (AUadapt) from InfluenzaB__AFJ76338__NA

SEQ ID NO: 29120 - RNA, 1401 nt, Artificial Sequence
  derived and/or modified CDS sequence (AUadapt) from InfluenzaB__AFJ77331__NA
augcugcccaguaccauccagacccucacgcuguuccugaccuccggcggggugcuccugagccuguacgucuccgccagccucuccuaccugcuguacagugacauccuccugaaguucucccagaccgagaucaccgccccgaucaugccccuggacugcgcgaacgccagcaaugugcaggccgugaaccacuccgccgccaagggcgucacgcuccugcugcccgagcccgaguggaccuacccgcgccucagcugccccggguccaccuuccagaaggcgcugcugaucaguccccaccgguucggcgagaccaaggggaacuccgcgccccucaucauccgcgagccguucaucgccugcggccccacggagugcaagcauuucgcccugacccacuacgccgcccagcccggcggguacuacaacggcacccgggaggaucgcaacaagcugcggcaccucaucucggugaagcuggggaagauccccaccguggagaacuccaucuuccacauggccgccuggaguggcuccgccugccacgacgggaaggaguggacguacaucggcgucgacggcccggacaguaacgcgcugcucaagaucaaguacggggaggccuacaccgacaccuaccacuccuaugccaagaacauccugcgcacccaggagagcgccuacaacugcaucggcggggacuguuaccugaugaucacggacggccccgccucgggcaucuccgagugccgguuccucaagauccgcgaggggcggaucaucaaggagaucuuccccaccggccgcgugaagcauaccgaggagugcacgugcggguucgcgagcaacaagaccaucgagugcgccugucgggacaacuccuacaccgccaagcgccccuucgugaagcugaacgucgagaccgacaccgccgagauccggcugauguguacggagaccuaccucgacaccccgcgccccaacgacggcagcaucaccgggcccugcgaguccgauggcgacaagggcagcgggggcaucaagggcggguucgugcaccagcggauggccuccaagaucgggcgcugguacucgcggacgauguccaagaccaagcgcaugggcaugggccuguaugugaaguacgacggggaccccuggaccgacagcgaggcgcuggcccucuccggcgucauggugagcauggaggagccggggugguauuccuucggcuucgagaucaaggacaagaagugcgacgugcccugcaucgggaucgagaugguccaugacggcggcaagaccacguggcacagcgccgccaccgccaucuacugccugaugggguccggccagcugcucugggacaccgugaccgggguggacauggcgcuguga

SEQ ID NO: 29121 - RNA, 1401 nt, Artificial Sequence; identical to SEQ ID NO: 28856
  derived and/or modified CDS sequence (AUadapt) from InfluenzaB__AFJ77351__NA

SEQ ID NO: 29122 - RNA, 1401 nt, Artificial Sequence; identical to SEQ ID NO: 28748
  derived and/or modified CDS sequence (AUadapt) from InfluenzaB__AFJ77362__NA

SEQ ID NO: 29123 - RNA, 1401 nt, Artificial Sequence; identical to SEQ ID NO: 28901
  derived and/or modified CDS sequence (AUadapt) from InfluenzaB__AFJ77384__NA

SEQ ID NO: 29124 - RNA, 1401 nt, Artificial Sequence; identical to SEQ ID NO: 28823
  derived and/or modified CDS sequence (AUadapt) from InfluenzaB__AFJ80132__NA

SEQ ID NO: 29125 - RNA, 1401 nt, Artificial Sequence
  derived and/or modified CDS sequence (AUadapt) from InfluenzaB__AFJ80143__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccagcaacgugcaggccgugaaccgcuccgccaccaagggcgucacccuccugcugcccgagccggaguggaccuacccccggcucucgugccccggguccacguuucagaaggcccugcugaucagcccccaccgcuucggcgagaccaaggggaacuccgcgccgcucaucauccgggagcccuucaucgccuguggccccaaggagugcaagcacuucgcccugacccacuacgccgcgcagcccggcggguacuauaacggcacccgcgaggaccggaacaagcugcgccaccucaucagcgugaagcuggggaagaucccgacgguggagaauuccaucuuccacauggccgccuggagcggcuccgccugccacgaugggcgggaguggaccuacaucggcgucgacggccccgacagcaacgcccugcucaagaucaaguacggggaggcguauaccgacaccuaccacuccuacgccaacaauauccugcgcacgcaggagucggccugcaacugcaucggcgggaacugcuaucugaugaucaccgacggcagcgccuccggcaucagcgagugccgguuccucaagauccgcgaggggcggaucaucaaggagaucuuucccaccggccgcguggagcacaccgaggagugcacgugcggguucgccuccaacaagaccaucgagugcgcgugucgggacaacagcuacaccgccaagcgccccuucgugaagcugaaugucgagaccgacacggccgagauccggcugaugugcaccgagaccuaccucgacaccccgcgccccgacgauggcuccaucacggggcccugcgagagcaacggcgacaagggcuccgggggcaucaagggcggguucgugcaccagcggauggccaguaagaucgggcgcugguacucccggaccaugagcaagaccaagcgcaugggcaugggccuguacgugaaguacgacggggaucccuggaccgacuccgacgcccuggcgcucagcggcgucaugguguccauggaggagccggggugguacagcuucggcuuugagaucaaggacaagaagugcgacgugcccugcaucgggaucgagaugguccacgauggcggcaagaagacguggcacuccgccgccaccgccaucuacugccugauggggagcggccagcugcucugggacaccgugaccgggguggacauggcccuguga

SEQ ID NO: 29126 - RNA, 1401 nt, Artificial Sequence
  derived and/or modified CDS sequence (AUadapt) from InfluenzaB__AFJ80154__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggccauccugaucaguccccaccgcuucggcgagaccaaggggaacuccgcgccgcugaucauccgggagcccuucaucgccugcggccccaaggagugcaagcauuucgcccucacccacuacgccgcgcagcccggcggguacuacaauggcacccgcgaggaccggaacaagcugcgccaccugaucagcgugaagcucgggaagaucccgacgguggagaacuccaucuuccauauggccgccuggucgggcuccgccugccacgacgggcgggaguggaccuacaucggcgucgacggccccgauagcaacgcccugcugaagaucaaguacggggaggcguacaccgacaccuaccauuccuacgccaacaacauccuccgcacgcaggagagcgccugcaacuguaucggcgggaacugcuaccugaugaucaccgacggcagcgccuccggcaucagugagugccgguuccugaagauccgcgaggggcggaucaucaaggagaucuuccccaccggccgcguggagcacaccgaggagugcacgugcggguuugccuccaacaagaccaucgagugcgcgugccgggacaacagcuauaccgccaagcgccccuucgugaagcucaacgucgagaccgacacggccgagauccggcugaugugcaccgagaccuaccuggacaccccgcgccccgaugacggcuccaucacggggcccugcgagagcaacggcgacaagggcuccgggggcaucaagggcggguuugugcaccagcggauggccagcaagaucgggcgcugguacucccggaccaugucgaagaccaagcgcaugggcaugggccucuacgugaaguacgauggggaccccuggaccgacuccgacgcccuggcgcugagcggcgucaugguguccauggaggagccggggugguacagcuuuggcuucgagaucaaggacaagaagugcgacgugcccugcaucgggaucgagaugguccacgauggcggcaagaagacguggcacuccgccgccaccgccaucuacugccucauggggagcggccagcugcugugggacaccgugaccgggguggacauggcccucuga

SEQ ID NO: 29127 - RNA, 1401 nt, Artificial Sequence
  derived and/or modified CDS sequence (AUadapt) from InfluenzaB__AFJ80165__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaucccccuggacugcgcgaacgccagcaacgugcaggccgugaaucgcuccgccaccaagggcgucacccuccugcugcccgagccggaguggaccuacccccggcucagcugccccggguccacguuccagaaggcccugcugaucucgccccaccgcuuuggcgagaucaaggggaacuccgcgccgcucaucauccgggagcccuucaucgccugcggccccaaggagugcaagcacuucgcccugacccacuaugccgcgcagcccggcggguacuacaacggcacccgcgaggaccggaacaagcugcgccaccucaucagcgugaagcuggggaagaucccgaccguggagaauuccaucuuccacauggccgccuggagcggcuccgccugccacgacgggaaggaguggacguauaucggcgucgacggccccgacagcaacgcccugcucaagaucaaguacggggaggcguacaccgacaccuaucacuccuacgccaacaacauccugcggacccaggagucggccugcaacuguaucggcgggaacugcuaccugaugaucacggacggcagcgccuccggcaucagcgagugucgcuuccucaagauccgggaggggcgcaucaucaaggagaucuuccccaccggccggguggagcacaccgaggagugcacgugcggguucgccuccaacaagaccaucgagugugcgugccgcgacaacucguacaccgccaagcggcccuucgugaagcugaaugucgagaccgacaccgccgagauccgccugaugugcacggagaccuaccucgacaccccgcggcccgacgacggcuccaucaccgggcccugcgagaguaacggcgacaagggcuccgggggcaucaagggcggguucgugcaccagcgcauggccagcaagaucgggcggugguacucccgcacgaugucgaagaccaagcggaugggcaugggccuguaugugaaguacgacggggaccccuggaccgacuccgacgcccuggcgcucagcggcgucaugguguccauggaggagccggggugguauagcuucggcuucgagaucaaggacaagaagugcgacauccccugcaucgggaucgagauggugcaugacggcggcaaggagaccuggcacuccgccgccacggccaucuacugccugauggggagcggccagcugcucugggacaccgucaccgggguggacauggcccuguga

SEQ ID NO: 29128 - RNA, 1401 nt, Artificial Sequence
  derived and/or modified CDS sequence (AUadapt) from InfluenzaB__AFJ80176__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgugcccacgaugccccuggacugcgccaacgcgaguaacgugcaggccgucaaccgcuccgccaccaagggcgugacccuccugcugcccgagccggaguggaccuacccccggcucucgugccccggguccacguuccagaaggcccugcugaucaguccccaccgcuucggcgagaccaaggggaacuccgccccgcucaucauccgggagcccuucaucgcgugcggccccaaggagugcaagcauuucgcccugacccacuacgccgcccagcccggcggguacuacaauggcacccgcgaggaccggaacaagcugcgccaccucaucagcgugaagcuggggaagaucccgacggucgagaacuccaucuuccauauggcggccuggagcggcuccgccugccacgacgggcgggaguggaccuacaucggcguggacggccccgauagcaacgcccugcucaagaucaaguacggggaggccuacaccgacaccuaccauuccuacgcgaacaacauccugcgcacgcaggagucggccugcaacuguaucggcgggaacugcuaccugaugaucaccgacggcagcgccuccggcaucagugagugccgguuccucaagauccgcgaggggcggaucaucaaggagaucuuccccaccggccgcguggagcacaccgaggagugcacgugcggguuugccuccaacaagaccaucgagugcgccugccgggacaacagcuauaccgcgaagcgccccuucgucaagcugaacguggagaccgacacggccgagauccggcugaugugcaccgagaccuaccucgacaccccgcgccccgaugacggcuccaucacggggcccugcgagagcaacggcgacaagggcuccgggggcaucaagggcggguuugugcaccagcggauggccucgaagaucgggcgcugguacucccggaccaugagcaagaccaagcgcaugggcaugggccuguacgucaaguacgauggggaccccuggaccgacuccgacgcccuggcccucagcggcgugaugguguccauggaggagccggggugguacagcuuuggcuucgagaucaaggacaagaagugcgacguccccugcaucgggaucgagauggugcacgauggcggcaagaagacguggcacuccgcggccaccgccaucuacugccugauggggagcggccagcugcucugggacaccgugaccggggucgacauggcccuguga

SEQ ID NO: 29129 - RNA, 1401 nt, Artificial Sequence
  derived and/or modified CDS sequence (AUadapt) from InfluenzaB__AFJ80187__NA
augcugcccaguaccauccagacccucacgcuguuccugaccuccggcggggugcuccugagccuguacgucuccgccagccucuccuaccugcuguacaguggcauccuccugaaguucuccccgaccgagaucaccgcccccacgaugccccugaacugcgcgaacgccagcaacuuucaggccgugaaccgcuccgccaccaagggggugacccuccugcugcccgagccggaguggaccuacccccggcucucgugccccggcuccacguuccagaaggcccugcugaucagcccccaucgcuucggggagaccaagggcaacuccgcgccgcucaucauccgggagcccuucaucgccugcggccccaaggagugcaagcacuuugcccugacccacuacgccgcgcagcccgggggcuacuacaacgggacccgcgaggaccggaauaagcugcgccaccucaucagcgucaagcugggcaagaucccgacgguggagaacuccaucuuccacauggccgccuggagcggguccgccugccaugacggccgggaguggaccuacaucggcguggacgggcccgacagcaacgcccugcucaagaucaaguauggcgaggcguacaccgacaccuaccacuccuacgccaacaauauccugcgcacgcaggagucggccugcaacugcaucgggggcgacugcuaucugaugaucaccgacggcagcgccuccgggaucagcgagugccgguuccucaagauccgcgagggccggaucaucaaggagaucuuccccaccgggcgcgucgagcauaccgaggagugcacgugcggcuucgccuccaacaagaccaucgagugcgcgugccgggauaacagcuacaccgccaagcgccccuucgugaagcugaacguggagaccgacacggccgagauccggcugaugugcaccgagaccuaucucgacaccccgcgccccgacgacggguccaucacgggccccugcgagagcaacggcgauaagggguccggcgggaucaagggcggguucguccaccagcggauggccucgaagaucggccgcugguacucccggaccaugagcaagaccaagcgcaugggcauggggcuguacgugaaguaugacggcgaccccuggaucgacuccgacgcccugacccucagcggggugauggucuccauggaggagccgggcugguacaguuucggguucgagaucaaggacaagaagugcgacgugcccugcaucggcaucgagauggugcaugacggcgggaagaagacguggcacuccgcggccaccgccaucuacugccugaugggcagcgggcagcugcucugggacaccgucaccggcguggacauggcccuguga

SEQ ID NO: 29130 - RNA, 1401 nt, Artificial Sequence; identical to SEQ ID NO: 29125
  derived and/or modified CDS sequence (AUadapt) from InfluenzaB__AFJ80198__NA

SEQ ID NO: 29131 - RNA, 1401 nt, Artificial Sequence; identical to SEQ ID NO: 28753
  derived and/or modified CDS sequence (AUadapt) from InfluenzaB__AFJ80220__NA

SEQ ID NO: 29132 - RNA, 1401 nt, Artificial Sequence
  derived and/or modified CDS sequence (AUadapt) from InfluenzaB__AFJ80231__NA
augcugcccaguaccauccagacccucacgcuguuccugaccuccggcggggugcuccugagccuguacgucuccgccagccucuccuaccugcuguacagcggcauccuccugaaguuuucccugaccgagaucaccgccccgacgaugccccucaacugcgcgaacgccucgaacgugcaggccgugaaccgcuccgccaccaagggggucacccuguuccugcccgagcccgaguggaccuauccgcggcucagcugccccggcuccacguuccagaaggcccugcugaucagcccccaccgcuucggggagaccaagggcaacuccgcgccccucaucauccgggagccguuuaucgccugcggccccaaggagugcaagcacuucgcccugacccacuacgccgcgcagcccgggggcuacuauaacgggacccgcgaggaccggaacaagcugcgccaccucaucagcguggagcugggcaagauccccacgguggagaacuccaucuuccauauggccgccuggucgggguccgccugccacgacggcaaggaguggaccuacaucggcgucgacgggccggacaguaacgcccugcucaagaucaaguacggcgaggcguacaccgacaccuaccacuccuacgccaauaacauccugcggacgcaggagagcgccugcaacugcaucgggggcgacugcuaccugaugaucaccgauggcagcgccuccgggaucucggagugccgcuuccucaagauccgggagggccgcaucaucaaggagaucuuccccaccgggcggguggagcacaccgaggagugcacguguggcuucgccuccaacaagaccaucgagugcgcgugccgcgacaacagcuauaccgccaagcggcccuucgugaagcugaacgucgagaccgacacggccgagauccgccugaugugcaccgagaccuaccucgacacgccccggccggacgauggguccaucaccggccccugcgagagcaacggcgacaagggguccggcgggaucaagggcggguucgugcaccagcgcauggccagcaagaucggccggugguauucccgcaccaugucgaagaccaagcggaugggcauggggcuguacgugaaguacgacggcgaccccuggaucgacuccgacgcccugacccucaguggggucaugguguccauggaggagcccggcugguacagcuucggguucgagaucaaggacaagaagugcgacgugccguguaucggcaucgagaugguccacgacggcgggaagaagacguggcacuccgcggccaccgccaucuacugccugaugggcagcgggcagcugcucugggacaccgugaccggcguggacauggcccuguga

SEQ ID NO: 29133 - RNA, 1401 nt, Artificial Sequence
  derived and/or modified CDS sequence (AUadapt) from InfluenzaB__AFJ80242__NA
augcugcccaguaccauccagacccucacgcuguuccugaccuccggcggggugcuccugagccuguacgucuccgcccuccugagcuaccugcucuacuccgauauccugcugaaguucagcccgaccaaggugaucgcccccaccaugucccucgacugcgcgaacgccucgaaugugcaggccgucaaccacuccgccacggaggagaugaccuuccugcugcccgagcccgaguggaccuacccgcgccucagcugccagggcuccaccuuccagaaggcccugcugaucaguccccaccgguucggggaggcgaagggcaacuccgcgccccucaucauccgcgagcccuucaucgccugcgggccgaaggagugcaagcauuucgcccugacgcacuacgccgcccagcccggcggcuacuacaacgggacccgggaggaucgcaacaagcugcggcaccucaucagcgugaaccugggcaagauccccaccguggagaacuccaucuuccacauggccgccuggaguggguccgccugccacgacggccgcgaguggaccuacaucggggucgacggccccgacaguaacgcgcugaucaagaucaaguacggcgaggccuacacggacaccuaccacuccuaugccaacaacauccuccggacccaggagagcgccugcaacugcaucgggggcgacuguuaccugaugaucaccgacgggagcgccuccggcaucagccgcugccgguuccugaagauccgcgagggccggaucaucaaggagaucuuuccgacggggcgcguggagcacaccgaggagugcacgugcggcuucgcguccaacaagaccaucgagugcgccugucgggacaacagcuacaccgccaagcgccccuucgugaagcucaacgucgagaccgacaccgccgagauccggcugauguguaccgagacguaccuggacacgccccgccccgacgacggguccaucaccggcccgugcgagucgaauggggacaagggcaacggcgggaucaagggcggguucgugcaccagcggauggccucccgcaucggccggugguacagccgcaccauguccaagaccaagcggauggggauggagcucuaugugaaguacgacggcgaccccuggaccgacagcgacgcgcuggcccccuccggcgucauggugagcauggaggagcccgggugguauuccuucggcuucgagaucaaggacaagaagugcgacgugccgugcaucgggaucgagaugguccaugacggcgggaagaccaccuggcacagcgccgccacggccaucuacugccugaugggcuccggccagcuccugugggacaccgugaccgggguggacauggcgcuguga

SEQ ID NO: 29134 - RNA, 1401 nt, Artificial Sequence
  derived and/or modified CDS sequence (AUadapt) from InfluenzaB__AFJ80660__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccagcaacgugcaggccgugaaccgcuccgccaccaagggcgucacccuccugcugcccgagccggaguggaccuacccccggcucucgugccccggguccacguuucagaaggcccugcugaucagcccccaccgcuucggcgagaccaaggggaacuccgcgccgcucaucauccgggagcccuucaucgccuguggccccaaggagugcaagcacuucgcccugacccacuacgccgcgcagcccggcggguacuauaacggcacccgcgaggaccggaacaagcugcgccaccucaucagcgugaagcuggggaagaucccgacgguggagaauuccaucuuccacauggccgccuggagcggcuccgccugccacgaugggcgggaguggaccuacaucggcgucgacggccccgacagcaacgcccugcucaagaucaaguacggggaggcguauaccgacaccuaccacuccuacgccaacaauauccugcgcacgcaggagucggccugcaacugcaucggcggggacugcuaucugaugaucaccgacggcagcgccuccggcaucagcgagugccgguuccucaagauccgcgaggggcggaucaucaaggagaucuuucccaccggccgcguggagcacaccgaggagugcacgugcggguucgccuccaacaagaccaucgagugcgcgugucgggacaacagcuacaccgccaagcgccccuucgugaagcugaaugucgagaccgacacggccgagauccggcugaugugcaccgagaccuaccucgacaccccgcgccccgacgauggcuccaucacggggcccugcgagagcaacggcgacaagggcuccgggggcaucaagggcggguucgugcaccagcggaugaccaguaagaucgggcgcugguacucccggaccaugagcaagaccaagcgcaugggcaugggccuguacgugaaguacgacggggaucccuggacggacuccgacgcccuggcccucagcggcgucaugguguccauggaggagccggggugguacagcuucggcuuugagaucaaggacaagaagugcgacgugcccugcaucgggaucgagaugguccacgauggcggcaagaagaccuggcacuccgcggccaccgccaucuacugccugauggggagcggccagcugcucugggacaccgugacggggguggacauggcccuguga

SEQ ID NO: 29135 - RNA, 1401 nt, Artificial Sequence; identical to SEQ ID NO: 29132
  derived and/or modified CDS sequence (AUadapt) from InfluenzaB__AFJ80671__NA

SEQ ID NO: 29136 - RNA, 1401 nt, Artificial Sequence; identical to SEQ ID NO: 29132
  derived and/or modified CDS sequence (AUadapt) from InfluenzaB__AFJ80682__NA

SEQ ID NO: 29137 - RNA, 1401 nt, Artificial Sequence
  derived and/or modified CDS sequence (AUadapt) from InfluenzaB__AFJ80693__NA
augcugcccaguaccauccagacccucacgcuguuccugaccuccggcggggugcuccugagccuguacgucuccgccagccucuccuaccugcuguauagcggcauccuccugaaguucuccccgaccgagaucaccgcccccacgaugccccugaacugcgcgaacgccaguaacgugcaggccgugaaccgcuccgccaccaagggggucacccuccugcugcccgagccggaguggaccuacccccggcucagcugccccggcuccacguuucagaaggcccugcugaucagcccccaccgcuucggggagaccaagggcaacuccgcgccgcucaucauccgggagcccuucaucgccuguggccccaaggagugcaagcacuucgcccugacccacuacgccgcgcagcccgggggcuauuacaacgggacccgcgaggaccggaacaagcugcgccaccucaucagugugaagcugggcaagaucccgacgguggagaacuccaucuuccacauggccgccuggagcggguccgccugccaugacggccgggaguggaccuacaucggcgucgacgggcccgacagcaaugcccugcucaagaucaaguacggcgaggcguacaccgacaccuaccacuccuaugccaacaacauccugcgcacgcaggagucggccugcaacuguaucgggggcgacugcuaccugaugaucaccgacggcagcgccuccgggaucagugagugccgguuccucaagauccgcgagggccggaucaucaaggagaucuuccccaccgggcgcguggagcacaccgaggagugcacguguggcuucgccuccaacaagaccaucgagugcgcgugccgggacaauagcuacaccgccaagcgccccuucgugaagcugaacgucgagaccgacacggccgagauccggcugauguguaccgagaccuaccucgacaccccgcgccccgacgacggguccaucacgggccccugcgagagucacggcgacaagggguccggcgggaucaagggcggguucgugcaccagcggauggccagcaagaucggccgcugguauucccggaccaugagcaagaccaagcgcaugggcauggggcuguacgugaaguacgacggcgaccccuggaucgauuccggggcccugacccucagcggcgucaugguguccauggaggagccggggugguacagcuucggcuucgagaucaaggauaagaagugcgacgugcccugcaucggcaucgagaugguccacgacgggggcaagaagacguggcauuccgcggccaccgccaucuacugccugauggggagcggccagcugcucugggacaccgugaccggcguggacauggcccuguga

SEQ ID NO: 29138 - RNA, 1401 nt, Artificial Sequence
  derived and/or modified CDS sequence (AUadapt) from InfluenzaB__AFJ80726__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgacgaugccccuggauugcgcgaacgccagcaacgugcaggccgugaaccgcuccgccaccaagggcgucacccuccugcugcccgagcccgaguggaccuauccgcggcucagcugccccggguccacguuccagaaggcccugcugaucagcccccaucgcuucggcgagaccaaggggaacuccgcgccccucaucauccgggagccguucaucgccugcggccccaaggagugcaagcauuucgcccugacccacuacgccgcgcagcccggcggguacuauaacggcacccgcgaggaccggaacaagcugcgccaccucaucagugugaagcuggggaagauccccacgguggagaacuccaucuuccacauggccgccuggagcggcuccgccugccaugacgggcgggaguggaccuacaucggcgucgacggcccggacaguaacgcccugcucaagaucaaguacggggaggcguacaccgacaccuaccauuccuacgccaagaacauccugcgcacgcaggagagcgccugcaauugcaucggcggggacugcuaccugaugaucaccgauggcagcgccuccggcaucagcgagugccgguuccucaagauccgcgaggggcggaucaucaaggagaucuuccccaccggccgcgugaagcauaccgaggagugcacgugcggguucgccuccaacaagaccaucgagugugcgugccgggacaacagcuacaccgccaagcgccccuuugugaagcugaacgucgagaccgacacggccgagauccggcugaugugcaccgagaccuaccucgauacgccccgcccgaacgacggcuccaucaccgggcccugcgagagcaauggcgaccggggcgggggcgggaucaagggcggguucgugcaccagcgcauggccuccaagaucggccggugguacagccgcaccauguccaagaccaagcggaugggcauggggcuguaugugaaguacgacggcgaccccuggaccgacagugaggcccuggcgcucuccggggucauggugcccauggaggagccgggcugguacagcuucggguucgagaucaaggacaagaagugugacgugcccugcaucggcaucgagaugguccacgacggcgggaagacgaccuggcauuccgccgccaccgccaucuacugccugaugggcagcgggcagcugcucugggacaccgugacgggcguggacauggcccuguga

SEQ ID NO: 29139 - RNA, 1401 nt, Artificial Sequence
  derived and/or modified CDS sequence (AUadapt) from InfluenzaB__AFJ80737__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaacgccaguaacgugcaggccgugaaccgcuccgccacgaagggcgucacccuccugcugcccgagcccgaguggaccuacccgcggcucagcugccccggguccaccuuucagaaggcccugcugaucagcccccaccgcuucggcgagacgaaggggaacuccgcgccccucaucauccgggagccguucaucgccugcggccccaaggaguguaagcacuucgcccugacccacuacgccgcgcagcccggcggguacuacaauggcacccgcgaggaccggaacaagcugcgccaccucaucagcgugaagcuggggaagauccccaccguggagaacuccaucuuucacauggccgccuggagcggcuccgccugccacgacgggcgggaguggacguacaucggcgucgauggcccggacucgaacgcccugcucaagaucaaguacggggaggcguacaccgauaccuaccacuccuacgccaagaacauccugcgcacccaggagagcgccugcaauugcauccggggcgacugcuaccugaugaucacggacgggcccgccagcggcaucuccgagugucgcuuccucaagauccgggagggccgcaucaucaaggagaucuuccccaccgggcgggugaagcacaccgaggagugcacgugcggcuuugccagcaacaagaccaucgagugcgcgugccgcgacaacuccuauaccgccaagcggcccuucgugaagcugaacgucgagaccgacaccgccgagauccgccugaugugcacggagaccuaccucgauaccccgcggcccaacgacgggagcaucaccggccccugcgaguccaacggggacaagggcaguggcgggaucaagggcggguucgugcaccagcgcauggccuccaagaucggccggugguacagccgcacgauguccaagaccaagcggauggggaugggccuguacgugaaguacgauggcgaccccuggaccgacagcgaggcccuggcgcucuccggggucauggugagcauggaggagccgggcugguacuccuuuggguucgagaucaaggacaagaagugcgacgugcccugcaucggcaucgagaugguccacgaugggggcaagaccacguggcacagcgccgccaccgccaucuacugccugaugggcuccgggcagcugcucugggacaccgugaccggcguggacauggcccuguga

SEQ ID NO: 29140 - RNA, 1401 nt, Artificial Sequence; identical to SEQ ID NO: 28781
  derived and/or modified CDS sequence (AUadapt) from InfluenzaB__AFJ80759__NA

SEQ ID NO: 29141 - RNA, 1401 nt, Artificial Sequence
  derived and/or modified CDS sequence (AUadapt) from InfluenzaB__AFJ80770__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgacgaugccccuggacugugcgaacgccagcaacgugcaggccgugaaccgcuccgccaccaagggcgucacccuccugcugcccgagcccgaguggaccuacccgcggcucaguugccccggguccacguuccagaaggcccugcugaucagcccccaccgcuuuggcgagaccaaggggaacuccgcgccccucaucauccgggagccguucaucgccugcggccccaacgagugcaagcauuucgcccugacccacuacgccgcgcagcccggcggguacuacaauggcacccgcgaggaccggaacaagcugcgccaccucaucagcgugaagcuggggaagauccccacgguggagaacuccaucuuucacauggccgccuggagcggcuccgccugccacgaugggcgggaguggaccuacaucggcgucgacggcccggacucgaacgcccugcucaagaucaaguauggggaggcguacaccgacaccuaccacuccuacgccaagaauauccugcgcacgcaggagagcgccugcaacugcaucggcggggauugcuaccugaugaucaccgacggccccgccagcggcaucuccgagugccgguuucucaagauccgcgaggggcggaucaucaaggagaucuuccccaccggccgcgugaagcacaccgaggagugcacgugcggguucgccaguaacaagaccaucgagugcgcgugccgggacaacuccuauaccgccaagcgccccuucgugaagcuggacgucgagaccgacacggccgagauccggcugaugugcaccgagaccuaucucgacaccccgcgccccaacgacggcagcaucacggggcccugcgaguccaauggcgacaagggcagcgggggcaucaagggcggguucgugcaccagcggauggccuccaagaucgggcgcugguacagucggacccuguccaagaccaagcgcaugggcaugggccuguacgugaaguacgacggggaccccuggaccgauagcgaggcccucgcgcuguccggcgucauggugagcauggaggagccggggugguacuccuucggcuucgagaucaaggauaagaagugcgacgugcccugcaucgggaucgagaugguccacgacggcggcaagacgaccuggcauagcgccgccaccgccaucuacugccugaugggguccggccagcuccugugggacaccgugacggggguggacauggcccuguga

SEQ ID NO: 29142 - RNA, 1401 nt, Artificial Sequence; identical to SEQ ID NO: 28781
  derived and/or modified CDS sequence (AUadapt) from InfluenzaB__AFJ80785__NA

SEQ ID NO: 29143 - RNA, 1401 nt, Artificial Sequence; identical to SEQ ID NO: 28781
  derived and/or modified CDS sequence (AUadapt) from InfluenzaB__AFJ80796__NA

SEQ ID NO: 29144 - RNA, 1401 nt, Artificial Sequence
  derived and/or modified CDS sequence (AUadapt) from InfluenzaB__AFJ80807__NA
augcugcccaguaccauccagacccucacgcuguuccugaccuccggcggggugcuccugagccuguacgucuccgugagccucuccuaccugcuguacucggauauccuccugaaguucccguccaccgagaucaccgcccccacgaugccccuggacugcgccaacgcgagcaacgugcaggccgucaaccgcuccgccaccaagggcgugacccuccugcugcccgagccggaguggaccuauccccggcucagcugccccggguccacguuccagaaggcccugcugaucucgccccaccgcuucggcgagaccaaggggaacuccgccccgcucaucauccgggagcccuuuaucgcgugcggccccaaggagugcaagcacuucgcccugacccacuacgccgcccagcccggcggguacuauaacggcacccgcggggaccggaacaagcugcgccaccucaucagcgugaagcugggcaagaucccgacggucgagaacuccaucuuccacauggcggccuggaguggguccgccugccacgacggcaaggaguggaccuacaucggcguggacgggcccgacaacaaugcccugcucaagaucaaguacggcgaggccuacaccgacaccuaccacucguacgcgaauaacauccugcggacgcaggaguccgccugcaacugcaucgggggcaacugcuaccugaugaucaccgauggcagcgccagcgggguguccgagugccgcuuccucaagauccgggagggccgcaucaucaaggagaucuuccccaccgggcggaucaagcacaccgaggagugcacguguggcuucgccucgaacaagaccaucgagugcgccugccgcgacaacuccuacaccgcgaagcggcccuuugucaagcugaacguggagaccgacacggccgagauccgccugaugugcaccgagaccuaccucgacaccccgcggcccgacgacgggaguaucacgggccccugcgaguccaacggcgacaaggggagcggcgggaucaagggcggguucgugcaccagcgcauggccuccaagaucggccggugguacagucgcaccauguccaagaccaagcggaugggcauggggcuguacgucaaguacgacggcgaccccugggccgacagcgacgcccuggcguuuuccggggugauggugagcauggaggagccgggcugguacuccuucggguucgagaucaaggacaagaagugcgacguccccuguaucggcaucgagauggugcacgacggcgggaaggagaccuggcacagcgccgccacggccaucuacugccucaugggcuccgggcagcugcugugggacaccgugaccggcgucaacauggcccucuga

SEQ ID NO: 29145 - RNA, 1401 nt, Artificial Sequence; identical to SEQ ID NO: 28781
  derived and/or modified CDS sequence (AUadapt) from InfluenzaB__AFJ80818__NA

SEQ ID NO: 29146 - RNA, 1401 nt, Artificial Sequence; identical to SEQ ID NO: 28781
  derived and/or modified CDS sequence (AUadapt) from InfluenzaB__AFJ80829__NA

SEQ ID NO: 29147 - RNA, 1401 nt, Artificial Sequence; identical to SEQ ID NO: 29118
  derived and/or modified CDS sequence (AUadapt) from InfluenzaB__AFJ80840__NA

SEQ ID NO: 29148 - RNA, 1401 nt, Artificial Sequence; identical to SEQ ID NO: 29118
  derived and/or modified CDS sequence (AUadapt) from InfluenzaB__AFJ80851__NA

SEQ ID NO: 29149 - RNA, 1401 nt, Artificial Sequence
  derived and/or modified CDS sequence (AUadapt) from InfluenzaB__AFJ80862__NA
augcugcccaguaccauccagacccucacgcuguuccugaccuccggcggggugcuccugagccuguacgucuccgccucgcucuccuaccugcuguacagcgauauccuccugaaguucccguccaccgagaucaccgcccccacgaugccccuggacugcgcgaacgccucgaacgugcaggccaugaaccgcuccgccaccaagggcgugacccuccugcugcccgagaccgaguggacguacccgcggcucaguugccccggguccaccuuccagaaggcccugcugaucagcccccaccgcuucggcgagaccaaggggaacuccgcgccccucaucauccgggagccguucaucgccugcggccccaaggaguguaagcacuucgcccugacccacuacgccgcgcagcccggcggguacuacaacggcacgcgcggggaccggaauaagcugcgccaccucaucucggucaagcugggcaagauccccaccguggagaacuccaucuuccacauggccgccuggagcggguccgccugccaugacggcaaggaguggaccuacaucggcguggacgggccggacaacaacgcccugcucaagaucaaguacggcgaggcguacaccgauacguaccacucguacgccaacaacauccugcggacccaggaguccgccugcaacuguaucgggggcaacugcuaccugaugaucaccgacggcagcgccucgggggucuccgagugccgcuuccucaagauccgggagggccgcaucaucaaggagaucuuucccaccgggcggaucaagcacacggaggagugcacgugcggcuucgccagcaacaagaccaucgagugcgcgugccgcgauaacuccuacaccgccaagcggcccuucgugaagcugaacguggagaccgacaccgccgagauccgccugaugugcaccgagaccuaccucgauacgccccggccggacgacgggagcaucaccggccccugcgaguccaacggcgacaaggggucgggcgggaucaagggcggguucguccaucagcgcauggccuccaagaucggccggugguacagccgcaccauguccaagaccgagcggaugggcauggggcuguacgugaaguacgacggcgaccccugggccgacucggaugcgcugacguucuccggggugauggucagcauggaggagcccggcugguacuccuucggguucgagaucaaggacaagaagugcgacgugccguguaucggcaucgagauggugcacgacggcgggaaggagaccuggcacagcgccgccaccgccaucuacugccucaugggcuccgggcagcugcugugggacaccgucacgggcgugaacauggcccucuga

SEQ ID NO: 29150 - RNA, 1401 nt, Artificial Sequence
  derived and/or modified CDS sequence (AUadapt) from InfluenzaB__AFJ80873__NA
augcugcccaguaccauccagacccucacgcuguuccugaccuccggcggggugcuccugagccuguacgucuccgccagccucucccaccuccuguauucgggcauccugcugaaguucccguccaccgagaucaccgcccccacgaugccccuggacugcgcgaacgccaguaacgugcaggccgugaaccgcuccgccaccaagggggucacccuccugcccccggagcccgaguggaccuacccccggcugagcugccccggcuccacguuccagaaggcccuccugaucaguccgcaccgcuucggggagaccaagggcaacuccgcgccccugaucauccgggagcccuucaucgccugcggccccaaggaguguaagcacuucgcccucacccacuacgccgcgcagcccgggggcuacuacaaugggacccgcggcgaccggaacaagcugcgccaccugaucucggugaagcucgggaagauccccacgguggagaacuccaucuuucacauggccgccuggagcggcuccgccugccacgacggcaaggaguggaccuauaucggggucgacggccccgacaacaacgcccugcugaagaucaaguacggggaggcguacaccgauaccuaccacagcuacgccaacaauauccuccggacgcaggaguccgccugcaacugcaucggcggcaacugcuaccugaugaucaccgaugggagcgccucgggcguguccgagugccgcuuccugaagauccgggaggggcgcaucaucaaggagaucuuccccaccggccggaucaagcauaccgaggagugcacgugcggguucgccagcaacaagaccaucgagugcgcgugucgcgacaacuccuacaccgccaagcggccguucgugaagcucaacgucgagaccgauacggccgagauccgccugaugugcaccgagaccuaccuggacaccccgcggcccgacgacggcaguaucacgggccccugcgaguccaacggggacaagggcagcgggggcaucaagggcggguucgugcaccagcgcauggccuccaagaucggccggugguauucgcgcaccauguccaagaccgagcggauggggaugggccucuacgugaaguacgacggggacccgugggccgauagcgacgcgcugaccuucuccggcgucauggugagcauggaggagcccgggugguacuccuucggcuuugagaucaaggacaagaagugcgacgugcccugcaucggcaucgagaugguccacgaugggggcaaggagacguggcacagcgccgccaccgccaucuacugccugaugggguccggccagcuccugugggacaccgugaccggcgugaacauggcccuguga

SEQ ID NO: 29151 - RNA, 1401 nt, Artificial Sequence
  derived and/or modified CDS sequence (AUadapt) from InfluenzaB__AFJ80884__NA
augcugcccaguaccauccagacccucacgcuguuccugaccuccggcggggugcuccugagccuguacgucuccgccucgcucuccuaccugcuguacagcgauauccuccugaaguucccguccaccgagaucaccgcccccacgaugccccuggacugcgcgaacgccagcaacgugcaggccgugaaccgcuccgccaccaagggcgucacccuccugcugcccgagccggaguggaccuauccccggcucucgugccccggguccacguuccagaaggcccugcugaucagcccccaccgcuucggcgagaccaaggggaacuccgcgccgcucaucauccgggagcccuuuaucgccugcggccccaaggagugcaagcacuucgcccugacccacuacgccgcgcagcccggcggguacuauaacggcacccgcggggaccggaacaagcugcgccaccucaucagcgugaagcugggcaagaucccgacgguggagaacuccaucuuccacauggccgccuggaguggguccgccugccacgacggcaaggaguggaccuacaucggcgucgacgggcccgacaacaaugcccugcucaagaucaaguacggcgaggcguacaccgacaccuaccacagcuacgccaauaacauccugcggacgcaggaguccgccugcaacugcaucgggggcaacugcuaccugaugaucaccgauggcucggccagcgggguguccaagugccgcuuccucaagauccgggagggccgcaucaucaaggagaucuuccccaccgggcggaucaagcacaccgaggagugcacguguggcuucgccagcaacaagaccaucgagugcgcgugccgcgacaacuccuacaccgccaagcggcccuuugugaagcugaacgucgagaccgacacggccgagauccgccugaugugcaccgagaccuaccucgacaccccgcggcccgacgacgggaguaucacgggccccugcgaguccaacggcgacaaggggagcggcgggaucaagggcggguucgugcaccagcgcauggccuccaagaucggccggugguacagucgcaccauguccaagaccgagcggaugggcauggggcuguacgugaaguacgacggcgaccccugggccgacucggacgcgcugaccuuuuccggggucauggugagcauggaggagccgggcugguacuccuucggguucgagaucaaggacaagaagugcgacgugcccuguaucggcaucgagaugguccacgacggcgggaaggagacguggcacagcgccgccaccgccaucuacugccucaugggcuccgggcagcugcugugggacaccgugaccggcgugaacauggcccucuga

SEQ ID NO: 29152 - RNA, 1401 nt, Artificial Sequence; identical to SEQ ID NO: 29117
  derived and/or modified CDS sequence (AUadapt) from InfluenzaB__AFJ80895__NA

SEQ ID NO: 29153 - RNA, 1401 nt, Artificial Sequence
  derived and/or modified CDS sequence (AUadapt) from InfluenzaB__AFJ80917__NA
augcugcccaguaccauccagacccucacgcuguuccugaccuccggcggggugcuccugagccuguacgucuccgccucgcucuccuaccugcuguacagcgauauccuccugaaguucccguccaccgagaucaccgcccccacgaugccccuggacugcgcgaacgccagcaacgugcaggccgugaaccgcuccgccaccaagggcgucacccuccugcugcccgagccggaguggaccuauccccggcucucgugccccggguccacguuccagaaggcccugcugaucagcccccaccgcuucggcgagaccaaggggaacuccgcgccgcucaucauccgggagcccuuuaucgccugcggccccaaggagugcaagcacuucgcccugacccacuacgccgcgcagcccggcggguacuauaacggcacccgcggggaccggaacaagcugcgccaccucaucagcgugaagcugggcaagaucccgacgguggagaacuccaucuuccacauggccgccuggaguggguccgccugccacgacggcaaggaguggaccuacaucggcgucgacgggcccgacaacaaugcccugcucaagaucaaguacggcgaggcguacaccgacaccuaccacagcuacgccaauaacauccugcggacgcaggaguccgccugcaacugcaucgggggcaacugcuaccugaugaucaccgauggcucggccagcgggguguccgagugccgcuuccucaagauccgggagggccgcaucaucaaggagaucuuccccaccgggcggaucaagcacaccgaggagugcacguguggcuucgccagcaacaagaccaucgagugcacgugccgcgacaacuccuacaccgcgaagcggcccuuugugaagcugaacgucgagaccgacaccgccgagauccgccugaugugcaccgagaccuaccucgacacgccgcggcccgacgacgggaguaucaccggccccugcgaguccaacggcgacaaggggagcggcgggaucaagggcggguucgugcaccagcgcauggccuccaagaucggccggugguacagucgcaccauguccaagaccgagcggaugggcauggggcuguacgugaaguacgacggcgaccccugggccgacucggacgcccugacguuuuccggggucauggugagcauggaggagccgggcugguacuccuucggguucgagaucaaggacaagaagugcgacgugcccuguaucggcaucgagaugguccacgacggcgggaaggagaccuggcacagcgcggccaccgccaucuacugccucaugggcuccgggcagcugcugugggacaccgugacgggcgugaacauggcccucuga

SEQ ID NO: 29154 - RNA, 1401 nt, Artificial Sequence
  derived and/or modified CDS sequence (AUadapt) from InfluenzaB__AFJ80928__NA
augcugcccaguaccauccagacccucacgcuguuccugaccuccggcggggugcuccugagccuguacgucuccgccucgcucuccuaccugcuguacagcgauauccuccugaaguucccguccaccgagaucaccgcccccacgaugccccuggacugcgcgaacgccagcaacgugcaggccgugaaccgcuccgccaccaagggcgucacccuccugcugcccgagccggaguggaccuauccccggcucucgugccccggguccacguuccagaaggcccugcugaucagcccccaccgcuucggcgagaccaaggggaacuccgcgccgcucaucauccgggagcccuuuaucgccugcgagcccaaggagugcaagcacuucgcccugacccacuacgccgcgcagcccggcggcuacuauaacgggacccgcggcgaccggaacaagcugcgccaccucaucagcgugaagcuggggaagaucccgacgguggagaacuccaucuuccacauggccgccuggaguggcuccgccugccacgacgggaaggaguggaccuacaucggcgucgacggccccgacaacaaugcccugcucaagaucaaguacggggaggcguacaccgacaccuaccacagcuacgccaauaacauccugcggacgcaggaguccgccugcaacugcaucggcgggaacugcuaccugaugaucaccgauggcucggccagcggcguguccgagugccgcuuccucaagauccgggaggggcgcaucaucaaggagaucuuccccaccggccggaucaagcacaccgaggagugcacguguggguucgccagcaacaagaccaucgagugcgcgugccgcgacaacuccuacaccgccaagcggcccuuugugaagcugaacgucgagaccgacacggccgagauccgccugaugugcaccgagaccuaccucgacaccccgcggcccgacgacggcaguaucacggggcccugcgaguccaacggcgacaagggcagcgggggcaucaagggcggguucgugcaccagcgcauggccuccaagaucgggcggugguacagucgcaccauguccaagaccgagcggaugggcaugggccuguacgugaaguacgacggggaccccugggccgacucggacgcgcugaccuuuuccggcgucauggugagcauggaggagccggggugguacuccuucggcuucgagaucaaggacaagaagugcgacgugcccuguaucgggaucgagaugguccacgacggcggcaaggagacguggcacagcgccgccaccgccaucuacugccucaugggguccggccagcugcugugggacaccgugaccggggugaacauggcccucuga

SEQ ID NO: 29155 - RNA, 1401 nt, Artificial Sequence
  derived and/or modified CDS sequence (AUadapt) from InfluenzaB__AFJ80939__NA
augcugcccaguaccauccagacccucacgcuguuccugaccuccggcggggugcuccugagccuguacgucuccgccagccucuccuaccugcuguauucggacauccuccugaaguucccgcccaccgaggugaccgcccccacgaugccccuggacugcgcgaacgccuccaaugugcaggccgucaaccgcagcgccaccaagggcgugacccuccugcugccggagcccgaguggaccuacccccggcucuccugccccgggagcacguuccagaaggcccugcugaucuccccgcaucgcuucggcgagaccaaggggaacagcgcgccccucaucauccgggagcccuucaucgccugcggccccaaggagugcaagcauuucgcccugacccacuacgccgcgcagccgggcggguacuacaacggcacccgcggggaucggaacaagcugcgccaccucaucuccgugaagcugggcaagauccccacggucgagaacucgaucuuccacauggccgccugguccgggagugccugccacgacggcaaggaguggaccuacaucggcguggacgggcccgauaacaacgcccugcucaagaucaaguacggcgaggcguacaccgacaccuaccauuccuacgccaacaacauccugcggacgcaggagagcgccugcaacuguaucgggggcaacugcuaccugaugaucaccgacggcuccgccagcggggugucggagugucgcuuccucaagauccgggagggccgcaucaucaaggagaucuuccccaccgggcggaucaagcacaccgaggagugcacgugcggcuucgccuccaauaagaccaucgagugcgcgugccgcgacaacagcuacaccgccaagcggccguuugucaagcugaacguggagaccgacacggccgagauccgccugaugugcaccgagaccuaccucgacacgccccggcccgaugacggguccaucaccggccccugcgagagcaacggcgacaagggguccggcgggaucaagggcggguucgugcaucagcgcauggccagcaagaucggccggugguacucccgcaccaugucgaagaccgagcggaugggcauggggcuguacgucaaguacgacggcgauccgugggccgacuccgacgcgcugaccuucagcggggugaugguguccauggaggagcccggcugguacagcuuuggguucgagaucaaggacaagaagugcgacguccccugcaucggcaucgagauggugcacgauggcgggaaggagacguggcacuccgccgccaccgccaucuacugccucaugggcagcgggcagcugcugugggacaccgugaccggcgucaacauggcccucuga

SEQ ID NO: 29156 - RNA, 1401 nt, Artificial Sequence
  derived and/or modified CDS sequence (AUadapt) from InfluenzaB__AFJ80950__NA
augcugcccaguaccauccagacccucacgcuguuccugaccuccggcggggugcuccugagccuguacgucuccgccagccucuccuaccugcuguauucggacauccuccugaaguucucccagaccgagaucaccgccccgaucaugccccuggacugcgcgaacgccaguaacgugcaggccgugaaccgcuccgccgccaagggcgucacgcuccugcugcccgagcccgaguggaccuacccgcggcucagcugccccggguccaccuuccagaaggcgcugcugaucaguccccaccgcuucggcgagaccaaggggaacuccgcgccccucaucauccgggagccguucaucgccugcggccccacggaguguaagcacuucgcccugacccacuacgccgcccagcccggcggguacuacaauggcacccgcgaggaccggaacaagcugcgccaccucaucucggugaagcuggggaagauccccaccguggagaacuccaucuuccauauggccgccuggagcggcuccgccugccacgacgggaaggaguggacguacaucggcgucgauggcccggacagcaacgcgcugcucaagaucaaguacggggaggccuacaccgacaccuaucacuccuacgccaagaacauccugcggacccaggagagcgccugcaacuguaucggcggggacugcuaccugaugaucacggacggccccgccucgggcaucuccgagugucgcuuccucaagauccgggaggggcgcaucaucaaggagaucuuccccaccggccgggugaagcacaccgaggagugcacgugcggguucgcgaguaacaagaccaucgagugcgccugccgcgacaacuccuacaccgccaagcggcccuuugugaagcugaacgucgagaccgacaccgccgagauccgccugaugugcacggagaccuaccucgacaccccgcggcccaaugacggcagcaucaccgggcccugcgaguccgacggcgacaagggcaacgggggcaucaagggcggguuugugcaccagcgcauggccagcaagaucgggcggugguacucccgcacgaugucgaagaccaagcggaugggcaugggccuguacgugaaguacgauggggaccccuggaccgacuccgaggcgcuggcccucagcggcgucaugguguccauggaggagccggggugguacagcuuuggcuucgagaucaaggacaagaagugcgacgugcccugcaucgggaucgagaugguccacgauggcggcaagaccacguggcacuccgccgccaccgccaucuacugccugauggggagcggccagcugcucugggacaccgugaccgggguggacauggcgcuguga

SEQ ID NO: 29157 - RNA, 1401 nt, Artificial Sequence; identical to SEQ ID NO: 29118
  derived and/or modified CDS sequence (AUadapt) from InfluenzaB__AFJ80961__NA

SEQ ID NO: 29158 - RNA, 1401 nt, Artificial Sequence; identical to SEQ ID NO: 28901
  derived and/or modified CDS sequence (AUadapt) from InfluenzaB__AFJ80972__NA

SEQ ID NO: 29159 - RNA, 1401 nt, Artificial Sequence; identical to SEQ ID NO: 28901
  derived and/or modified CDS sequence (AUadapt) from InfluenzaB__AFJ80983__NA

SEQ ID NO: 29160 - RNA, 1401 nt, Artificial Sequence; identical to SEQ ID NO: 28856
  derived and/or modified CDS sequence (AUadapt) from InfluenzaB__AFJ80994__NA

SEQ ID NO: 29161 - RNA, 1401 nt, Artificial Sequence; identical to SEQ ID NO: 28901
  derived and/or modified CDS sequence (AUadapt) from InfluenzaB__AFJ81005__NA

SEQ ID NO: 29162 - RNA, 1401 nt, Artificial Sequence; identical to SEQ ID NO: 28901
  derived and/or modified CDS sequence (AUadapt) from InfluenzaB__AFJ84364__NA

SEQ ID NO: 29163 - RNA, 1401 nt, Artificial Sequence
  derived and/or modified CDS sequence (AUadapt) from InfluenzaB__AFJ90399__NA
augcugcccaguaccauccagacccucacgcuguuccugaccuccggcggggugcuccugagccuguacgucuccgccagccucuccuaccugcuguauagcgacauccuccugaaguucccguccaccgagaucaccgccccgcccaugccccuggacugcgcgaaugccagcaacgugcaggccgugaaccgcuccgccacgaagggcgucacccuccugcugcccgagcccgaguggaccuacccccggcucagcugucccggguccaccuuccagcgcgcccugcugaucagcccgcaccgguucggcgagacgaaggggaacuccgcgccccucaucauccgcgagcccuuuaucgccugcggcccccgggagugcaagcacuucgcccugacccacuaugccgcgcagccgggcggguacuacaacggcacccgcggggaccggaacaagcugcgccaucucaucagcgugaagcugggcaagauccccaccguggagaacuccaucuuccacauggccgccuggagcggguccgccugccaugacggcaaggaguggacguacaucggcgucgacgggcccgacaacaaugcccugcucaagaucaaguacggcgaggcguacaccgacaccuaccacaguuacgccaacaacauccugcggacccaggaguccgccugcaacuguaucgggggcaacugcuaccugaugaucacggacggcagcgccagugggguguccgagugccgcuuccucaagauccgggagggccgcaucaucaaggagaucuuccccaccgggcggaucaagcacaccgaggagugcacguguggcuucgccagcaacaagaccaucgagugcgcgugccgcgauaacuccuacaccgccaagcggccguucgugaagcugaacgucgagaccgacaccgccgagauccgccugaugugcacggagaccuaucucgacacgccccggcccgacgacgggagcaucaccggccccugcgaguccaauggcgacaaggggagcggcgggaucaagggcggguucgugcaccagcgcaugaccuccaagaucggccggugguacagucgcaccauguccaagaccgagcggaugggcauggggcuguacgugaaguacgacggcgacccgugggccgacagugacgcccugaccuucuccggggucauggugagcauggaggagcccggcugguacuccuucggguuugagaucaaggacaagaagugcgacgugcccugcaucggcaucgagaugguccacgauggcgggaaggagacguggcacagcgcggccaccgccaucuacugccucaugggcuccgggcagcugcugugggacaccgugaccggcgugaacauggcccucuga

SEQ ID NO: 29164 - RNA, 1401 nt, Artificial Sequence
  derived and/or modified CDS sequence (AUadapt) from InfluenzaB__AFJ90410__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaacgccaguaacgugcaggccgugaaccgcuccgccgccaagggcgucacgcuccugcugcccaagcccgaguggaccuacccgcggcucagcugccccggguccaccuuccagaaggcgcugcugaucaguccccaccgcuucggcgagaccaaggggaacuccgcgccccucaucauccgggagccguucaucgccugcggccccacggaguguaagcacuucgcccugacccacuacgccgcccagcccggcggguacuacaauggcacccgcgaggaccggaacaaccugcgccaccucaucagcgugaagcuggggaagauccccaccguggagaacuccaucuuucacauggccgccuggagcggcuccgccugccacgacgggaaggaguggacguauaucggcgucgacggcccggacucgaacgcgcugcucaagaucaaguacggggaggccuacaccgauaccuaccacuccuacgccaagaacauccugcggacccaggagagcgccugcaauugcaucggcggggacugcuaccugaugaucacggacggccccgccaguggcaucuccgagugccgcuuccucaagauccgggaggggcgcaucaucaaggagaucuuccccaccggccgggugaagcacaccgaggagugcacgugcggguuugcgagcaacaagaccaucgagugcgccugccgcgacaacuccuauaccgccaagcggcccuucgugaagcugaacgucgagaccgacaccgccgagauccgccugaugugcacggagaccuaccucgauaccccgcggcccaacgacggcagcaucaccgggcccugcgaguccgacggcgacaagggcagugggggcaucaagggcggguucgugcaccagcgcauggccuccaagaucgggcggugguacagccgcacgauguccaagaccaagcggaugggcaugggccuguacgugaaguacgauggggaccccuggaccgacagcgaggcgcuggcccucuccggcgucauggugagcauggaggagccggggugguacuccuuuggcuucgagaucaaggacaagaagugcgacgugcccugcaucgggaucgagaugguccacgauggcggcaagaccacguggcacagcgccgccaccgccaucuacugccugaugggguccggccagcugcucugggacaccgugaccgggguggacauggcgcuguga

SEQ ID NO: 29165 - RNA, 1401 nt, Artificial Sequence
  derived and/or modified CDS sequence (AUadapt) from InfluenzaB__AFJ90432__NA
augcugcccaguaccauccagacccucacgcuguuccugaccuccggcggggugcuccugagccuguacgucuccaccagccucuccuaccugcuguauagcgacauccuccugaaguucucccagaccgagaucacggccccgaucaugccccuggacugcgccaacgcgaguaacgugcaggccgugaaccgcuccgccgccaagggcgucacccuccugcugcccgagcccgaguggaccuacccgcggcucagcugccccggguccaccuuucagaaggcccugcugaucagcccccaccgcuucggcgagacgaaggggaacuccgcgccccucaucauccgggagccguucaucgccugcggccccaccgaguguaagcacuucgcccugacccacuacgccgcgcagcccggcggguacuacaauggcacccgcgaggaccggaacaagcugcgccaccucaucagcgugaagcuggggaagauccccacgguggagaacuccaucuuucacauggccgccuggagcggcuccgccugccacgacgggaaggaguggaccuacaucggcgucgauggcccggacucgaacgcccugcucaagaucaaguacggggaggcguacaccgauaccuaccacuccuacgccaagaacauccugcggacgcaggagagcgccugcaauugcaucggcggggacugcuaccugaugaucaccgacggccccgccagcggcaucuccgagugucgcuuccucaagauccgggaggggcgcaucaucaaggagaucuuccccaccggccgggugaagcacaccgaggagugcacgugcggguuugccagcaacaagaccaucgagugcgcgugccgcgacaacuccuauaccgccaagcggcccuucgugaagcugaacgucgagaccgacacggccgagauccgccugaugugcaccgagaccuaccucgauaccccgcggcccaacgacggcagcaucacggggcccugcgaguccgacggcgacaagggcagugggggcaucaagggcggguucgugcaccagcgcauggccuccaagaucgggcggugguacagccgcaccauguccaagaccaagcggaugggcaugggccuguacgugaaguacgauggggaccccuggaccgacagcgaggcccuggcgcucuccggcgucauggugagcauggaggagccggggugguacuccuuuggcuucgagaucaaggacaagaagugcgacgugcccugcaucgggaucgagaugguccacgauggcggcaagacgaccuggcacagcgccgccaccgccaucuacugccugaugggguccggccagcugcucugggacaccgugacggggguggacauggcccuguga

SEQ ID NO: 29166 - RNA, 1401 nt, Artificial Sequence; identical to SEQ ID NO: 29085
  derived and/or modified CDS sequence (AUadapt) from InfluenzaB__AFJ90443__NA

SEQ ID NO: 29167 - RNA, 1401 nt, Artificial Sequence
  derived and/or modified CDS sequence (AUadapt) from InfluenzaB__AFJ90454__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucgugccccuggacugcgcgaaugccagcaacgugcaggccgucaaccgcuccgccgccaagggcgugacgcuccugcugcccgagcccgaguggaccuacccgcggcucagcugucccggguccaccuuccagaaggcgcugcugaucucgccccaccgcuucggcgagaccaaggggaacuccgcgccccucaucauccgggagccguucaucgccuguggccccacggagugcaagcacuucgcccugacccacuacgccgcccagcccggcgaguauuacaacgggacccgcgaggaccggaacaagcugcgccaccucaucagugugaagcugggcaagauccccaccgucgagaacuccaucuuccacauggccgccuggagcggguccgccugccaugacggcaaggaguggacguacaucgggguggacggcccggacagcaacgcgcugcucaagaucaaguauggcgaggccuacaccgacaccuaccacuccuacgccaagaauauccugcggacccaggagagcgccugcaacugcaucgggggcgacuguuaccugaugaucacggacgggcccgccagcggcaucuccgagugccgcuuccucaagauccgggagggccgcaucaucaaggagaucuuucccaccgggcgggugaagcacaccgaggagugcacgugcggcuucgcgucgaacaagaccaucgagugugccugccgcgacaacuccuacaccgccaagcggcccuucgucaagcugaauguggagaccgacaccgccgagauccgccugaugugcacggagaccuaccucgacaccccgcggcccaacgaugggagcaucaccggccccugcgaguccgacggggacaagggcagcggcgggaucaagggcggguuugugcaccagcgcauggccuccaagaucggccggugguacagccgcacgauguccaagaccaagcggauggggaugggccuguacgucaaguacgacggcgaucccuggaccgacagcgaggcgcuggcccucuccggggugauggugagcauggaggagccgggcugguacuccuucggguuugagaucaaggacaagaagugcgacguccccugcaucggcaucgagauggugcacgaugggggcaagaccacguggcacagcgccgccaccgccaucuacugccugaugggcuccgggcagcugcucugggacaccgugaccggcgucgacauggcgcuguga

SEQ ID NO: 29168 - RNA, 1401 nt, Artificial Sequence
  derived and/or modified CDS sequence (AUadapt) from InfluenzaB__AFJ91042__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaacgccaguaacgugcaggccgugaaccgcuccgccgccaagggcgucacgcuccugauccccgagcccgaguggaccuacccgcggcugagcugccccggguccaccuuucagaaggcgcuccugaucagcccccaccgcuucggcgagaccaaggggaacuccgcgccccugaucauccgggagccguucaucgccugcggccccacggaguguaagcacuucgcccucacccacuacgccgcccagcccggcggguacuacaauggcacccgcgaggaccggaacaagcugcgccaccugaucagcgugaagcucgggaagauccccaccguggagaacuccaucuuucacauggccgccuggagcggcuccgccugccacgacgggaaggaguggacguacaucggcgucgauggcccggacucgaacgcgcugcugaagaucaaguacggggaggccuacaccgauaccuaccacuccuacgccaagaacauccuccggacccaggagagcgccugcaauugcaucggcggggacugcuaccugaugaucacggacggccccgccagcggcaucuccgagugucgcuuccugaagauccgggaggggcgcaucaucaaggagaucuuccccaccggccgggugaagcacaccgaggagugcacgugcggguuugcgagcaacaagaccaucgagugcgccugccgcgacaacuccuauaccgccaagcggcccuucgugaagcucaacgucgagaccgacaccgccgagauccgccugaugugcacggagaccuaccuggauaccccgcggcccaacgacggcagcaucgccgggcccugcgaguccgacggcgacaagggcagugggggcaucaagggcggguucgugcaccagcgcaugaccuccaagaucgggcggugguacagccgcacgauguccaagaccaagcggaugggcaugggccucuacgugaaguacgauggggaccccuggaccgacagcgaggcgcuggcccuguccggcgucauggugagcauggaggagccggggugguacuccuuuggcuucgagaucaaggacaagaagugcgacgugcccugcaucgggaucgagaugguccacgauggcggcaagaccacguggcacagcgccgccaccgccaucuacugccucaugggguccggccagcugcugugggacaccgugaccgggguggacauggcgcucuga

SEQ ID NO: 29169 - RNA, 1401 nt, Artificial Sequence
  derived and/or modified CDS sequence (AUadapt) from InfluenzaB__AFJ91053__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaacgccaguaacgugcaggccgugaaccgcuccgccgccaaggaggucacgcuccugcugcccgagcccgaguggaccuacccgcggcucagcugccccggcuccaccuuucagaaggcgcugcugaucagcccccaccgcuucggggagaccaagggcaacuccgcgccccucaucauccgggagccguucaucgccugcgggcccacggaguguaagcacuucgcccugacccacuacgccgcccagcccggcggcuacuacaaugggacccgcgaggaccggaacaagcugcgccaccucaucagcgugaagcugggcaagauccccaccguggagaacuccaucuuucacauggccgccuggagcggguccgccugccacgacggcaaggaguggacguacaucggggucgauggcccggacucgaacgcgcugcucaagaucaaguacggcgaggccuacaccgauaccuaccacuccuacgccaagaacauccugcggacccaggagagcgccugcaauugcaucgggggcgacugcuaccugaugaucacggacgggcccgccagcggcaucuccgagugucgcuuccucaagauccgggagggccgcaucaucaaggagaucuuccccaccgggcgggugaagcacaccgaggagugcacgugcggcuuugcgagcaacaagaccaucgagugcgccugccgcgacaacuccuauaccgccaagcggcccuucgugaagcugaacgucgagaccgacaccgccgagauccgccugaugugcacggagaccuaccucgauaccccgcggcccaacgacgggagcaucaccggccccugcgaguccgacggggacaagggcaguggcgggaucaagggcggguucgugcaccagcgcauggccuccaagaucggccggugguacagccgcacgauguccaagaccaagcggauggggaugggccuguacgugaaguacgauggcgaccccuggaccgacagcgaggcgcuggcccucuccggggucauggugagcauggaggagccgggcugguacuccuuuggguucgagaucaaggacaagaagugcgacgugcccugcaucggcaucgagaugguccacgaugggggcaagaccacguggcacagcgccgccaccgccaucuacugccugaugggcuccgggcagcugcucugggacaccgugaccggcguggacauggcgcuguga

SEQ ID NO: 29170 - RNA, 1401 nt, Artificial Sequence
  derived and/or modified CDS sequence (AUadapt) from InfluenzaB__AFJ91075__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaacgccaguaacgugcaggccgugaaccgcuccgccgccaagggcgucacgcuccugcugcccgagcccgaguggaccuacccgcggcucagcugccccggguccaccuuucagaaggcgcugcugaucagcccccaccgcuucggcgagaccaaggggaacuccgcgccccucaucauccgggagccguucaucgccugcggccccacggaguguaagcacuucgcccugacccacuacgccgcccagcccggcggguacuacaauggcacccgcgaggaccggaacaagcugcgccaccucaucagcgugaagcuggggaagauccccaccguggagaacuccaucuuucacauggccgccuggagcggcuccgccugccacgacgggaaggaguggacguacaucggcgucgauggcccggacucgaacacccugcucaagaucaaguacggggaggcguacaccgauaccuaccacuccuacgccaagaacauccugcggacgcaggagagcgccugcaauugcaucggcggggacugcuaccugaugaucaccgacggccccgccagcggcaucuccgagugucgcuuccucaagauccgggaggggcgcaucaucaaggagaucuuccccaccggccgggugaagcacaccgaggagugcacgugcggguuugccagcaacaagaccaucgagugcgcgugccgcgacaacuccuauaccgccaagcggcccuucgugaagcugaacgucgagaccgacacggccgagauccgccugaugugcaccgagaccuaccucgauaccccgcggcccaacgacggcagcaucacggggcccugcgaguccgacggcgacaagggcagugggggcaucaagggcggguucgugcaccagcgcauggccuccaagaucgggcggugguacagccgcaccauguccaagaccaagcggaugggcaugggccuguacgugaaguacgauggggaccccuggaccgacagcgaggcccuggcgcucuccggcgucauggugagcauggaggagccggggugguacuccuuuggcuucgagaucaaggacaagaagugcgacgugcccugcaucgggaucgagaugguccacgauggcggcaagacgaccuggcacagcgccgccaccgccaucuacugccugaugggguccggccagcugcucugggacaccgugacggggguggacauggcccuguga

SEQ ID NO: 29171 - RNA, 1401 nt, Artificial Sequence; identical to SEQ ID NO: 28686
  derived and/or modified CDS sequence (AUadapt) from InfluenzaB__AFJ91086__NA

SEQ ID NO: 29172 - RNA, 1401 nt, Artificial Sequence; identical to SEQ ID NO: 28686
  derived and/or modified CDS sequence (AUadapt) from InfluenzaB__AFJ91097__NA

SEQ ID NO: 29173 - RNA, 1401 nt, Artificial Sequence; identical to SEQ ID NO: 28686
  derived and/or modified CDS sequence (AUadapt) from InfluenzaB__AFJ91108__NA

SEQ ID NO: 29174 - RNA, 1401 nt, Artificial Sequence; identical to SEQ ID NO: 28686
  derived and/or modified CDS sequence (AUadapt) from InfluenzaB__AFJ91119__NA

SEQ ID NO: 29175 - RNA, 1401 nt, Artificial Sequence; identical to SEQ ID NO: 28781
  derived and/or modified CDS sequence (AUadapt) from InfluenzaB__AFJ91707__NA

SEQ ID NO: 29176 - RNA, 1401 nt, Artificial Sequence
  derived and/or modified CDS sequence (AUadapt) from InfluenzaB__AFK09801__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgacgaugccccuggacugugcgaacgccagcaacgugcaggccgugaaccgcuccgccaccaagggcgucacccuccugcugcccgagcccgaguggaccuacccgcggcucaguugccccggguccacguuccagaaggcccugcugaucagcccccaccgcuuuggcgagaccaaggggaacuccgcgccccucaucauccgggagccguucaucgccugcggccccaaggagugcaagcacuuugcccugacccacuacgccgcgcagcccggcggguacuacaacggcacccgcgaggaucggaacaagcugcgccaccucaucagcgugaagcuggggaagauccccacgguggagaacuccaucuuucacauggccgccuggagcggcuccgccugccacgacgggcgggaguggaccuauaucggcgucgacggcccggacucgaacgcccugcucaagaucaaguacggggaggcguauaccgacaccuaccacuccuacgccaagaauauccugcgcacgcaggagagcgccugcaacugcaucggcggggacuguuaccugaugaucaccgacggcagcgccuccggcaucagcgagugccgguuucucaagauccgcgaggggcggaucaucaaggagaucuuccccaccggccgcgugaagcacaccgaggagugcacgugcggguuugccuccaacaagaccaucgagugcgcgugccgggacaacaguuacaccgccaagcgccccuucgugaagcugaacgucgagaccgacacggccgagauccggcugaugugcaccgagaccuaucucgacacgccccgcccgaacgacggcuccaucaccgggcccugcgagaguaacggcgaccggggcuccgggggcaucaagggcggguucgugcaccagcgcauggccagcaagaucgggcggugguauucccgcaccaugagcaagaccaagcggaugggcaugggccuguacgugaaguacgacggggaccccuggaccgauuccgaggcccuggcgcucagcggcgucauggugcccauggaggagccggggugguacuccuucggcuucgagaucaaggauaagaagugcgacgugcccugcaucgggaucgagaugguccacgacggcggcaagacgaccuggcauagcgccgccaccgccaucuacugccugaugggguccggccagcugcucugggacaccgugacggggguggacauggcccuguga

SEQ ID NO: 29177 - RNA, 1401 nt, Artificial Sequence; identical to SEQ ID NO: 28905
  derived and/or modified CDS sequence (AUadapt) from InfluenzaB__AFN54669__NA

SEQ ID NO: 29178 - RNA, 1401 nt, Artificial Sequence; identical to SEQ ID NO: 28905
  derived and/or modified CDS sequence (AUadapt) from InfluenzaB__AFN54680__NA

SEQ ID NO: 29179 - RNA, 1401 nt, Artificial Sequence; identical to SEQ ID NO: 28686
  derived and/or modified CDS sequence (AUadapt) from InfluenzaB__AFN54691__NA

SEQ ID NO: 29180 - RNA, 1401 nt, Artificial Sequence; identical to SEQ ID NO: 28686
  derived and/or modified CDS sequence (AUadapt) from InfluenzaB__AFN54702__NA

SEQ ID NO: 29181 - RNA, 1401 nt, Artificial Sequence; identical to SEQ ID NO: 28686
  derived and/or modified CDS sequence (AUadapt) from InfluenzaB__AFN54713__NA

SEQ ID NO: 29182 - RNA, 1401 nt, Artificial Sequence; identical to SEQ ID NO: 28686
  derived and/or modified CDS sequence (AUadapt) from InfluenzaB__AFN54724__NA

SEQ ID NO: 29183 - RNA, 1401 nt, Artificial Sequence; identical to SEQ ID NO: 28686
  derived and/or modified CDS sequence (AUadapt) from InfluenzaB__AFN54735__NA

SEQ ID NO: 29184 - RNA, 1401 nt, Artificial Sequence; identical to SEQ ID NO: 28686
  derived and/or modified CDS sequence (AUadapt) from InfluenzaB__AFN54746__NA

SEQ ID NO: 29185 - RNA, 1401 nt, Artificial Sequence; identical to SEQ ID NO: 28686
  derived and/or modified CDS sequence (AUadapt) from InfluenzaB__AFN54757__NA

SEQ ID NO: 29186 - RNA, 1401 nt, Artificial Sequence; identical to SEQ ID NO: 28686
  derived and/or modified CDS sequence (AUadapt) from InfluenzaB__AFN54768__NA

SEQ ID NO: 29187 - RNA, 1401 nt, Artificial Sequence; identical to SEQ ID NO: 28686
  derived and/or modified CDS sequence (AUadapt) from InfluenzaB__AFN54779__NA

SEQ ID NO: 29188 - RNA, 1401 nt, Artificial Sequence; identical to SEQ ID NO: 28686
  derived and/or modified CDS sequence (AUadapt) from InfluenzaB__AFN54790__NA

SEQ ID NO: 29189 - RNA, 1401 nt, Artificial Sequence; identical to SEQ ID NO: 28686
  derived and/or modified CDS sequence (AUadapt) from InfluenzaB__AFN54801__NA

SEQ ID NO: 29190 - RNA, 1401 nt, Artificial Sequence; identical to SEQ ID NO: 28686
  derived and/or modified CDS sequence (AUadapt) from InfluenzaB__AFN54812__NA

SEQ ID NO: 29191 - RNA, 1401 nt, Artificial Sequence
  derived and/or modified CDS sequence (AUadapt) from InfluenzaB__AFN54834__NA
augcugcccaguaccauccagacccucacgcuguuccugaccuccggcggggugcuccugagccuguacgucuccgccagccucuccuaccugcuguacagugacauccuccugaaguucucccgcaccgagaucaccgccccgaucaugccccuggacugcgcgaacgccagcaaugugcaggccgugaaccgguccgccacgaagggcgucacccuccugcugcccgagcccgaguggaccuacccgcgccucagcugccccggguccaccuuccagaaggcccugcugaucagcccccaccgguuuggcgagacgaaggggaacuccgcgccccucaucauccgcgagccguucaucgccugcggccccaaggagugcaagcacuucgcccugacccauuacgccgcgcagcccggcggguacuacaacggcacccgggaggaccgcaacaagcugcggcaccucaucagugugaagcuggggaagauccccaccguggagaacuccaucuuccacauggccgccuggagcggcuccgccugccacgaugggcgcgaguggaucuacaucggcgucgacggcccggacagcaacgcccugcucaagaucaaguacggggaggcguacacggauaccuaccacuccuacgccaagaacauccugcggacccaggagagcgccugcaauugcaucggcggggacugcuaccugaugaucaccgacggccccgccucgggcaucuccgagugucgcuuccucaagauccgggaggggcgcaucaucaaggagaucuuccccacgggccgggugaagcacaccgaggagugcacgugcggguucgccagcaauaagaccaucgagugcgcgugccgcgacaacuccuacaccgccaagcggcccuucgugaagcugaaugucgagaccgacaccgccgagauccgccugaugugcaccgagacguaccucgacaccccgcggcccaacgacggcagcaucaccgggcccugugaguccaacggcgacaagggcagcgggggcaucaagggcggguucgugcaccagcgcauggccuccaagaucgggcggugguacagucgcaccauguccaagacgaagcggaugggcaugggccuguacgugaaguacgacggggaccccuggaccgacagcgaggcccuggcgcucuccggcgucauggugagcauggaggagccggggugguauuccuucggcuucgagaucaaggacaagaagugcgacgugcccugcaucgggaucgagaugguccaugacggcggcaagaccaccuggcacagcgccgccacggccaucuacugccugaugggguccggccagcugcucugggacaccgugaccggggugaacaugacccuguga

SEQ ID NO: 29192 - RNA, 1401 nt, Artificial Sequence; identical to SEQ ID NO: 28686
  derived and/or modified CDS sequence (AUadapt) from InfluenzaB__AFN54845__NA

SEQ ID NO: 29193 - RNA, 1401 nt, Artificial Sequence
  derived and/or modified CDS sequence (AUadapt) from InfluenzaB__AFN54856__NA
augcugcccaguaccauccagacccucacgcuguuccugaccuccggcggggugcuccugagccuguacgucuccgccagccucuccuaccugcuguauagcgacauccuccugaaguucucccgcaccgagaucaccgccccgaucaugccccuggacugcgcgaaugccucgaacgugcaggccgugaaccgguccgccacgaagggcgucacccuccugcugcccgagcccgaguggaccuacccgcgccucagcugucccggguccaccuuccagaaggcccugcugaucagcccccaccgguucggcgagacgaaggggaacuccgcgccccucaucauccgcgagccguucaucgccuguggccccaaggagugcaagcacuucgcccugacccacuacgccgcgcagcccggcggguauuacaacggcacccgggaggaccgcaacaagcugcggcaccucaucagugugaagcuggggaagauccccaccguggagaacuccaucuuccacauggccgccuggagcggcuccgccugccaugacgggcgcgaguggacguacaucggcgucgacggcccggacucgaacgcccugcucaagaucaaguauggggaggcguacaccgacaccuaccacuccuacgccaagaauauccugcggacccaggagagcgccugcaacugcaucggcggggacuguuaccugaugaucacggacggccccgccagcggcguguccgagugccgcuuccucaagauccgggaggggcgcaucaucaaggagaucuuucccaccggccgggugaagcacaccgaggagugcacgugcggguucgccagcaacaagaccaucgagugugcgugccgcgacaacuccuacaccgccaagcggcccuucgucaagcugaauguggagaccgacaccgccgagauccgccugaugugcacggagaccuaccucgacaccccgcggcccaacgauggcagcaucaccgggcccugcgaguccaacggcgacaagggcucggggggcaucaagggcggguuugugcaccagcgcauggccuccaagaucgggcggugguacagccgcacgauguccaagaccaagcggaugggcaugggccuguacgucaaguacgacggggaucccuggaccgacagcgaggcccuggcgcucuccggcgugauggugagcauggaggagccggggugguacuccuucggcuuugagaucaaggacaagaagugcgacguccccugcaucgggaucgagauggugcacgauggcggcaagaccacguggcacagcgccgccaccgccaucuacugccugaugggguccggccagcugcucugggacaccgccaccggggugaacaugacgcuguga

SEQ ID NO: 29194 - RNA, 1401 nt, Artificial Sequence; identical to SEQ ID NO: 28686
  derived and/or modified CDS sequence (AUadapt) from InfluenzaB__AFN54867__NA

SEQ ID NO: 29195 - RNA, 1401 nt, Artificial Sequence
  derived and/or modified CDS sequence (AUadapt) from InfluenzaB__AFU34598__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugagccuggacugcgcgaacgccuccaaugugcaggccgugaaccgcagcgccaccaagggcgucaccuuccuccugcccgagcccgaguggaccuacccgcggcuguccugccccgggagcacguuucagaaggcccuccugaucagcccccaccgcuucggcgagaccaaggggaacuccgcgccccugaucauccgggagccguucaucgccugcggccccaaugagugcaagcacuucgcccucacccacuacgccgcgcagcccggcggguacuauaacggcacccgcggggaccggaacaagcugcgccaccugaucuccgugaagcucggcaagauccccacgguggagaacagcaucuuucacauggccgccugguccgggagcgccugccacgacggcaaggaguggaccuacaucggcgucgaugggccggacaacaacgcccugcugaaggugaaguacggcgaggcguacaccgacaccuaucacuccuacgccaacaagauccuccggacgcgcgagucggccugcaacuguaucgggggcaacugcuaccugaugaucaccgacggcagcgccuccggggugagcgagugucgguuccugaagauccgcgucggccggaucaucaaggagaucuuccccaccgggcgcgugaagcacaccgaggagugcacgugcggcuucgccuccaauaagaccaucgagugcgcgugccgggacaacagcuacaccgccaagcgccccuuugugaagcucaacgucgagaccgacacggccgagauccggcugaugugcaccgacaccuaccuggacacgccccgcccggaugacggguccaucaccggccccugcgagagcaacggcgacaagggguccggcgggaucaagggcggguucgugcaucagcggauggagagcaagaucggccgcugguacucccggaccaugagcaagaccgagcgcaugggcauggggcucuacgugaaguacgacggcgaucccugggccgacuccgacgcccuggcguucagcggggucaugguguccaugaaggagcccggcugguacagcuuuggguucgagaucaaggacaagaagugcgacgugccgugcaucggcaucgagaugguccacgauggcgggaaggagaccuggcacuccgccgccacggccaucuacugccugaugggcagcgggcagcuccugugggacaccgugaccggcguggacgucgcccuguga

SEQ ID NO: 29196 - RNA, 1401 nt, Artificial Sequence
  derived and/or modified CDS sequence (AUadapt) from InfluenzaB__AFU34609__NA
augcugcccaguaccauccagacccucacgcuguuccugaccuccggcggggugcuccugagccuguacgucuccgcccuccugagcuaccugcucuauuccgacauccugcugaaguucagcccgaccgagaucaccgcccccacgaugucccucgacugcgcgaaugccagcaacgugcaggccgugaaccgcuccgccacccggggcgucaccuuccugcugcccgagcccgagugggccuacccgcgccucaguugccccggguccaccuuccagaaggcgcugcugaucagcccccaccgguucggcgagacgaaggggaacuccgcgccccucaucauccgcgagccguuuaucgccugcggccccaacgagugcaagcacuucgcccugacccauuacgccgcccagcccggcggguacuacaacggcacccgcggggaccggaauaagcugcggcaccucaucagcgugaagcugggcaagauccccaccguggagaacuccaucuuccacauggccgccuggaguggguccgccugccacgacggcaaggaguggacguacaucggcgucgacgggccggacaaugacgcgcugcucaaggugaaguacggcgaggccuacaccgacaccuaccauagcuacgccaacaagauccugcgcacccaggaguccgccugcaacuguaucgggggcaacugcuaccugaugaucacggacggcagcgccagugggguguccgagugccgguuccucaagauccgcgagggccggaucaucaaggagaucuuccccaccgggcgcgucaagcacaccgaggagugcacgugcggcuuugcgagcaacaagaccaucgagugcgccugccgggacaauuccuacaccgccaagcgccccuucgugaagcugaacguggagaccgacaccgccgagauccggcugaugugcacggauaccuaccucgacacgccccgcccggacgacgggagcaucaccggccccugugaguccaacggcgacaaggggagcggcgggaucaagggcggguucguccaccagcggauggaguccaagaucggccgcugguacagucggaccauguccaagaccgagcgcaugggcauggggcuguacgugaaguacgacggcgaccccugggccgacagugacgcgcuggccuucuccggggugauggucagcaugaaggagcccggcugguacuccuucggguuugagaucaaggacaagaagugcgacgugccgugcaucggcaucgagauggugcacgauggcgggaaggagaccuggcacagcgccgccaccgccaucuacugccucaugggcuccgggcagcugcugugggacacggucaccggcguggacauggcgcucuga

SEQ ID NO: 29197 - RNA, 1401 nt, Artificial Sequence
  derived and/or modified CDS sequence (AUadapt) from InfluenzaB__AFU34620__NA
augcugcccaguaccauccagacccucacgcuguuccugaccuccggcggggugcuccugagccuguacgucuccgcccuccugagcuaccugcucuauuccgacauccugcugaaguucagcccgaccgagaucaccgcccccacgaugucccucgacugcgcgaacgccaguaacgugcaggccgugaaccgcuccgccacccggggcgucaccuuccugcugcccgagcccgaguggaccuacccgcgccucagcugucccggguccacguuccagaaggcccugcugaucagcccccaccgguucggcgagaccaaggggaacuccgcgccccucaucauccgcgagccguucaucgccuguggccccaacgagugcaagcacuucgcccugacccacuaugccgcgcagcccggcggguacuacaacggcacccgcggggaccggaacaagcugcggcaccucaucagugugaagcugggcaagauccccacgguggagaacuccaucuuccacauggccgccuggagcggguccgccugccacgauggcaaggaguggaccuacaucggcgucgacgggccggacaacgacgcccugcucaaggugaaguauggcgaggcguacaccgacaccuaccacagcuacgccaauaagauccugcgcacgcaggaguccgccugcaacugcaucgggggcaacugcuaucugaugaucaccgacggcagcgccagcgggguguccgagugccgguuccucaagauccgcgagggccggaucaucaaggagaucuuccccaccgggcgcgucaagcauaccgaggagugcacgugcggcuucgccagcaacaagaccaucgagugugcgugccgggacaacuccuacaccgccaagcgccccuucgugaagcugaacguggagaccgauacggccgagauccggcugaugugcaccgacaccuaccucgacacgccccgcccggacgacgggaguaucaccggccccugcgaguccaacggcgacaaggggagcggcgggaucaagggcggguucguccaucagcggauggaguccaagaucggccgcugguacagccggaccauguccaagaccgagcgcaugggcauggggcuguacgugaaguacgacggcgaccccugggccgauagcgacgcccuggcguucuccggggugauggucagcaugaaggagcccggcugguacuccuuuggguucgagaucaaggacaagaagugcgacgugccgugcaucggcaucgagauggugcacgauggcgggaaggagaccuggcacagcgccgccacggccaucuacugccucaugggcuccgggcagcugcugugggacaccgucaccggcguggacauggcccucuga

SEQ ID NO: 29198 - RNA, 1401 nt, Artificial Sequence
  derived and/or modified CDS sequence (AUadapt) from InfluenzaB__AFU34631__NA
augcugcccaguaccauccagacccucacgcuguuccugaccuccggcggggugcuccugagccuguacgucuccgcccuccugagcuaccugcucuauuccgacauccugcugaaguucagcccgaccgagaucaccgcccccacgaugucccucgacugcgcgaacgccaguaacgugcaggccgugaaccgcuccgccacccggggcgucaccuuccugcugcccgagcccgaguggaccuacccgcgccucagcugucccggguccacguuccagaaggcccugcugaucagcccccaccgguucggcgagaccaaggggaacuccgcgccccucaucauccgcgagccguucaucgccuguggccccaacgagugcaagcacuucgcccugacccacuaugccgcgcagcccggcggguacuacaacggcacccgcggggaccggaacaagcugcggcaccucaucagugugaagcugggcaagauccccacgguggagaacuccaucuuccacauggccgccuggagcggguccgccugccacgauggcaaggaguggaccuacaucggcgucgacgggccggacaacgacgcccugcucaaggugaaguauggcgaggcguacaccgacaccuaccacagcuacgccaauaagauccugcgcacgcaggaguccgccugcaacugcauccgggggaacugcuaucugaugaucaccgacggcagcgccagcggcguguccgagugccgcuuccucaagauccgggaggggcgcaucaucaaggagaucuuccccaccggccgggucaagcauaccgaggagugcacgugcggguucgccagcaacaagaccaucgagugugcgugccgcgacaacuccuacaccgccaagcggcccuucgugaagcugaacguggagaccgauacggccgagauccgccugaugugcaccgacaccuaccucgacacgccccggccggacgacggcaguaucaccgggcccugcgaguccaacggcgacaagggcagcgggggcaucaagggcggguucguccaucagcgcauggaguccaagaucgggcggugguacagccgcaccauguccaagaccgagcggaugggcaugggccuguacgugaaguacgacggggaccccugggccgauagcgacgcccuggcguucuccggcgugauggucagcaugaaggagcccgggugguacuccuuuggcuucgagaucaaggacaagaagugcgacgugccgugcaucgggaucgagauggugcacgauggcggcaaggagaccuggcacagcgccgccacggccaucuacugccucaugggguccggccagcugcugugggacaccgucaccgggguggacauggcccucuga

SEQ ID NO: 29199 - RNA, 1401 nt, Artificial Sequence
  derived and/or modified CDS sequence (AUadapt) from InfluenzaB__AFU34642__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugagccuggacugcgcgaacgccuccaacgugcaggccgugaaucgcucggccaccaagggcaugaccuuccuccugcccgagcccgaguggaccuacccgcggcuguccugccccgggagcacguuccagaaggcccuccugaucagcccccaucgcuucggcgagaccaaggggaacuccgcgccccugaucauccgggagccguucaucgccugcggccccaacggcugcaagcacuuugcccucacccacuacgccgcgcagcccgggggcuacuacaacgggacccgcggcgaccggaacaagcugcgccaucugaucuccgucaagcucgggaagauccccacgguggagaacagcaucuuccacauggccgccugguccggcagcgccugccacgauggcaaggaguggaccuacaucgggguggacggcccggacaacaacgcccugcugaaggucaaguacggggaggcguacaccgauaccuaccacuccuacgccaacaagauccuccggacgcaggagucggccugcaacuguaucggcggcaacugcuaccugaugaucaccgacgggagcgccuccggcgugagcgagugucgcuuccugaagauccgggaggggcgcaucaucaaggagaucuuccccaccggccgggugaagcacaccgaggagugcacgugcggguucgccuccaacaagaccaucgagugugcgugccgcgacaacagcuacaccgccaagcggcccuucgucaagcucaacguggagaccgauacggccgagauccgccugaugugcaccgacaccuaccuggacacgccccggccggacgacggcuccaucaccggccccugcgagaguuacggggacaagggcuccgggggcaucaagggcggguucgugcaccagcgcauggagucgaagaucggccggugguacucccgcaccaugagcaagaccgagcggauggggaugggccucuaugucaaguacgacggggaccccugggccgacuccgacgcccuggcguucagcggcgugaugguguccaugaaggagcccgggugguauagcuucggcuucgagaucaaggacaagaagugcgacgucccgugcaucggcaucgagauggugcaugacgggggcaaggagaccuggcacuccgccgccacggccaucuacugccugauggggagcggccagcuccugugggacaccgugaccggcgucgacauggcccuguga

SEQ ID NO: 29200 - RNA, 1401 nt, Artificial Sequence
  derived and/or modified CDS sequence (AUadapt) from InfluenzaB__AGB97261__NA
augcugcccaguaccauccagacccucacgcuguuccugaccuccggcggggugcuccugagccuguacgucuccgccagccucuccuaccugcuguacagugacaugcuccugaaguucucccgcaccgagaucaccgccccgaucaugccccuggacugcgcgaacgccagcaaugugcaggccgugaaccgguccgccacgaagggcgucacccuccugcugcccgagcccgaguggaccuacccgcgccucagcugccccggguccaccuuccagaaggcccugcugaucagcccccaucgguucggcgagacgaaggggaacuccgcgccccucaucauccgcgagccguucaucgccugcggccccaaggagugcaagcacuuugcccugacccacuacgccgcgcagcccggcggguacuacaacggcacccgggaggaccgcaauaagcugcggcaccucaucucggugaagcuggggaagauccccaccguggagaacuccaucuuccacauggccgccuggagcggcuccgccugucacgacgggcgcgaguggacguacaucggcgucgacggcccggacagcaaugcccugcucaagaucaaguacggggaggcguacaccgacaccuaccacuccuacgccaagaauauccugcggacccaggagagcgccugcaacugcaucggcggggacugcuaucugaugaucacggacggccccgccucgggcaucuccgagugccgcuuccucaagauccgggaggggcgcaucaucaaggagaucuuccccaccggccgggugaagcacaccgaggaguguacgugcggguucgccagcaacaagaccaucgagugcgcgugccgcgauaacuccuacaccgccaagcggcccuucgugaagcugaacgucgagaccgacaccgccgagauccgccugaugugcacggagaccuaucucgacaccccgcggcccaacgacggcagcaucaccgggcccugcgaguccaacggcgauaagggcagcgggggcaucaagggcggguucgugcaccagcgcauggccuccaagaucgggcggugguacucgcgcacgauguccaagaccaagcggaugggcaugggccuguacgugaaguaugacggggaccccuggaccgacagcgaggcccuggcgcucuccggcgucauggugagcauggaggagccggggugguacuccuuuggcuucgagaucaaggacaagaagugcgacgugcccugcaucgggaucgagaugguccacgauggcggcaagaccacguggcacagcgccgccaccgccaucuacugccugaugggguccggccagcugcucugggacaccgugaccggggugaacaugacgcuguga

SEQ ID NO: 29201 - RNA, 1401 nt, Artificial Sequence
  derived and/or modified CDS sequence (AUadapt) from InfluenzaB__AGB97267__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcacgaacgcgaguaacgugcaggccgugaaccgcuccgccgccaagggcgucacccuccugcugcccgagcccgaguggaccuacccgcggcucagcugccccggguccaccuuucagaaggcccugcugaucagcccccaccgcuucggcgagaucaaggggaacuccgcgccccucaucauccgggagccguucaucgccugcggccccacggaguguaagcacuucgcccugacccacuacgccgcgcagcccggcggguacuacaauggcacccgcgaggaccggaacaagcugcgccaccucaucagcgugaagcuggggaagauccccaccguggagaacuccaucuuucacauggccgccuggagcggcuccgccugccacgacgggaaggaguggacguacaucggcaucgauggcccggacucgaacgcccugcucaagaucaaguacggggaggcguacaccgauaccuaccacuccuacgccaagaacauccugcggacccaggagagcgccugcaauugcaucggcggggacugcuaccugaugaucacggacggccccgccagcggcgucuccgagugucgcuuccucaagauccgggaggggcgcaucaucaaggagaucuuccccaccggccgggugaagcacaccgaggagugcacgugcggguuugccagcaacaagaccaucgagugcgcgugccgcgacaaccgguauaccgccaagcgccccuucgugaagcugaacgucgagaccgacaccgccgagauccggcugaugugcacggagaccuaccucgauaccccgcgccccaacgacggcuccaucaccgggcccugcgagagcgacggcgacaagggcuccgggggcaucaagggcggguuugugcaccagcggauggccucgaagaucgggcgcugguacucccggacgaugagcaagaccaagcgcaugggcaugggccuguacgugaaguacgauggggaccccuggaccgacuccgaggcccuggcgcucagcggcgucaugguguccauggaggagccggggugguacagcuuuggcuucgagaucaaggacaagaagugcgacgugcccugcaucgggaucgagaugguccacgauggcggcaagaccacguggcacuccgccgccaccgccaucuacugccugauggggagcggccagcugcucugggacaccgugaccgggguggacauggcccuguga

SEQ ID NO: 29202 - RNA, 1401 nt, Artificial Sequence; identical to SEQ ID NO: 28686
  derived and/or modified CDS sequence (AUadapt) from InfluenzaB__AGR54784__NA

SEQ ID NO: 29203 - RNA, 1401 nt, Artificial Sequence; identical to SEQ ID NO: 28795
  derived and/or modified CDS sequence (AUadapt) from InfluenzaB__AGX15491__NA

SEQ ID NO: 29204 - RNA, 1401 nt, Artificial Sequence
  derived and/or modified CDS sequence (AUadapt) from InfluenzaB__AGX15533__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaacgaguguaagcacuucgcccugacccacuacgccgcgcagcccggcggguacuacaauggcaagcgcggggaccggaacaagcugcgccaccucaucagcgugaagcugggcaagaucccgaccguggagaacuccaucuuccauauggccgccuggagcggguccgccugccacgacggcaaggaguggacguacaucggcgucgacgggcccgauaacaacgcccugcucaagaucaaguacggcgaggcguacaccgacaccuaccauucguacgccaacaacauccugcggacccaggaguccgccugcaacuguaucgggggcaacugcuaccugaugaucacggacggcagcgccagcgggguguccgagugucgcuuccucaagauccgggagggccgcaucaucaaggagaucuuccccaccgggcgggugaagcacaccgaggagugcacgugcggcuucgccaguaacaagaccaucgagugcgcgugccgcgacaacuccuacaccgccaagcggcccuuugucaagcugaacguggagaccgacaccgccgagauccgccugaugugcacggacaccuaccucgacaccccgcggcccgaugacgggagcaucaccggccccugcgaguccaacggcgacaaggggucgggcgggaucaagggcggguuugugcaccagcgcauggccuccaaggucggccggugguacagccgcacgauguccaagaccgagcggaugggcauggggcuguacgugaaguacgacggcgaucccugggccgacagcgacgcgcuggccuucuccggggugauggucagcaugaaggagccgggcugguacuccuuuggguucgagaucaaggacaagaagugcgacgugcccugcaucggcaucgagauggugcacgauggcgggaaggagaccuggcacagcgccgccaccgccaucuacugccucaugggcuccgggcagcugcugugggacacggucaccggcguggacauggcgcucuga

SEQ ID NO: 29205 - RNA, 1401 nt, Artificial Sequence; identical to SEQ ID NO: 28748
  derived and/or modified CDS sequence (AUadapt) from InfluenzaB__AGX15545__NA

SEQ ID NO: 29206 - RNA, 1401 nt, Artificial Sequence; identical to SEQ ID NO: 28748
  derived and/or modified CDS sequence (AUadapt) from InfluenzaB__AGX15556__NA

SEQ ID NO: 29207 - RNA, 1401 nt, Artificial Sequence
  derived and/or modified CDS sequence (AUadapt) from InfluenzaB__AGX15567__NA
augcugcccaguaccauccagacccucacgcuguuccugaccuccggcggggugcuccugagccuguacgucuccgccagccucuccuaccugcuguacagugacauccuccugaaguucccguccaccgagaucaccgcccccacgaugccccuggacugcgcgaacgccagcaaugugcaggccgugaaccgcuccgccaccaagggcgucacccuccugcugcccgagccggaguggaccuacccccggcucagcugccccggguccacguuccagaaggcccugcugaucagcccccaucgcuucggcgagaccaaggggaacuccgcgccgcucaucauccgggagcccuucaucgccugcggccccaaggagugcaagcacuuugcccugacccacuacgccgcgcagcccggcggguacuacaacggcacccgcggggaccggaacaagcugcgccaucucaucucggugaagcugggcaagaucccgacgguggagaacuccaucuuccacauggccgccuggagcggguccgccugccaugacggcaaggaguggaccuacaucggcgucgacgggcccgacaacaacgcccugcucaagaucaaguauggcgaggcguacaccgacaccuaccacagcuacgccaauaacauccugcggacgcaggaguccgccugcaacugcaucgggggcaacugcuaccugaugaucaccgauggcagcgccucggggguguccgagugccgcuuccucaagauccgggagggccgcaucaucaaggagaucuuccccaccgggcggaucaagcacaccgaggaguguacgugcggcuucgccagcaacaagaccaucgagugcgcgugccgcgauaacuccuacaccgccaagcggcccuucgugaagcugaacgucgagaccgacacggccgagauccgccugaugugcaccgagaccuaucucgacaccccgcggcccgacgacgggagcaucacgggccccugcgaguccaacggcgacaaggggaguggcgggaucaagggcggguucgugcaccagcgcauggccuccaagaucggccggugguacucgcgcaccauguccaagaccgagcggaugggcauggggcuguacgugaaguacgauggcgaccccugggccgacagcgacgcgcuggccuucuccggggucauggugagcauggaggagccgggcugguauuccuucggguucgagaucaaggacaagaagugcgacgugcccugcaucggcaucgagaugguccaugacggcgggaaggagaccuggcacagcgccgccacggccaucuacugccucaugggcuccgggcagcugcugugggacaccgugaccggcgugaacauggcgcucuga

SEQ ID NO: 29208 - RNA, 1401 nt, Artificial Sequence; identical to SEQ ID NO: 28748
  derived and/or modified CDS sequence (AUadapt) from InfluenzaB__AGX15578__NA

SEQ ID NO: 29209 - RNA, 1401 nt, Artificial Sequence; identical to SEQ ID NO: 28748
  derived and/or modified CDS sequence (AUadapt) from InfluenzaB__AGX15589__NA

SEQ ID NO: 29210 - RNA, 1401 nt, Artificial Sequence; identical to SEQ ID NO: 28954
  derived and/or modified CDS sequence (AUadapt) from InfluenzaB__AGX15600__NA

SEQ ID NO: 29211 - RNA, 1401 nt, Artificial Sequence; identical to SEQ ID NO: 28954
  derived and/or modified CDS sequence (AUadapt) from InfluenzaB__AGX15611__NA

SEQ ID NO: 29212 - RNA, 1401 nt, Artificial Sequence; identical to SEQ ID NO: 28640
  derived and/or modified CDS sequence (AUadapt) from InfluenzaB__AGX15644__NA

SEQ ID NO: 29213 - RNA, 1401 nt, Artificial Sequence; identical to SEQ ID NO: 28640
  derived and/or modified CDS sequence (AUadapt) from InfluenzaB__AGX15655__NA

SEQ ID NO: 29214 - RNA, 1401 nt, Artificial Sequence; identical to SEQ ID NO: 28640
  derived and/or modified CDS sequence (AUadapt) from InfluenzaB__AGX15666__NA

SEQ ID NO: 29215 - RNA, 1401 nt, Artificial Sequence; identical to SEQ ID NO: 28640
  derived and/or modified CDS sequence (AUadapt) from InfluenzaB__AGX15679__NA

SEQ ID NO: 29216 - RNA, 1401 nt, Artificial Sequence
  derived and/or modified CDS sequence (AUadapt) from InfluenzaB__AGX15690__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaacgugcaggccgugaaucgcuccgccaccaagggcgucacccuccugcugcccgagccggaguggaccuacccccggcucagcugccccggguccacguuccagaaggcccugcugaucucgccccaccgcuucggcgagaccaaggggaauuccgcgccgcucaucauccgggagcccuucaucgccugcggccccaacgagugcaagcacuucgcccugacccacuaugccgcgcagcccggcggguacuacaacggcacccgcggggaccggaacaagcugcgccaccucaucagugugaagcugggcaagaucccgacgguggagaacuccaucuuccacauggccgccuggagcggguccgccugccacgacggcaaggaguggaccuauaucggcgucgacgggcccgacaacaacgcccugcucaaggugaaguacggcgaggcguacaccgacaccuaucacucguacgccaacaagauccugcggacgcaggaguccgccugcaacugcaucgggggcaauugcuaccugaugaucaccgacggcagcgccagcgggguguccgagugccgcuuucucaagauccgggagggccgcaucaucaaggagaucuuccccaccgggcgggucaagcacaccgaggagugcacgugcggcuucgccucgaacaagaccaucgagugugcgugccgcgacaacuccuacaccgccaagcggcccuucgugaagcugaacguggagaccgacacggccgagauccgccugauguguaccgacaccuaccucgacaccccgcggcccaacgacgggagcaucacgggccccugcgaguccaauggcgacaaggggagcggcgggaucaagggcggguucguccaccagcgcaugaaguccaagaucggccggugguacucgcgcaccauguccaagaccgagcggaugggcauggggcuguaugugaaguacgacggcgaccccugggccgacagcgacgcccuggcguucuccggggugauggucaguaugaaggagccgggcugguacuccuucggguucgagaucaaggacaagaagugcgacgugcccugcaucggcaucgagauggugcaugacggcgggaaggagaccuggcacagcgccgccacggccaucuacugccucaugggcuccgggcagcugcugugggacaccgucaccggcguggacauggcccucuga

SEQ ID NO: 29217 - RNA, 1401 nt, Artificial Sequence; identical to SEQ ID NO: 28640
  derived and/or modified CDS sequence (AUadapt) from InfluenzaB__AGX15701__NA

SEQ ID NO: 29218 - RNA, 1401 nt, Artificial Sequence
  derived and/or modified CDS sequence (AUadapt) from InfluenzaB__AGX15712__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagccgaaggggaacuccgcgccccucaucauccgggagcccuucaucgccugcggccccaacgaguguaagcacuucgcccugacccacuacgccgcgcagccgggcggguacuacaauggcacccgcggggaccggaacaagcugcgccaccucaucagcgugaagcugggcaagauccccaccguggagaacuccaucuuccauauggccgccuggagcggguccgccugccacgacggcaaggaguggacguacaucggcgucgacgggcccgauaacaacgcccugcucaaggugaaguacggcgaggcguacaccgacaccuaccauucguacgccaacaagauccugcggacccaggaguccgccugcaacugcaucgggggcaauugcuaccugaugaucacggacggcagcgccagcgggguguccgagugucgcuuccucaagauccgggagggccgcaucaucaaggagaucuuccccaccgggcgggucaagcacaccgaggagugcacgugcggcuucgccaguaacaagaccaucgagugcgcgugccgcgacaacuccuacaccgccaagcggccguuugugaagcugaacguggagaccgacaccgccgagauccgccugaugugcacggacaccuaccucgacacgccccggcccaaugacgggagcaucaccggccccugcgaguccgacggcgacaaggggucgggcgggaucaagggcggguuuguccaccagcgcauggaguccaagaucggccggugguacagccgcaccauguccaagaccgagcggaugggcauggggcuguacgugaaguacgacggcgauccgugggccgacagcgacgcccuggcguucuccggggugauggucagcaugaaggagcccggcugguacuccuuuggguucgagaucaaggacaagaagugcgacgugcccugcaucggcaucgagauggugcacgauggcgggaaggagaccuggcacagcgccgccaccgccaucuacugccucaugggcuccgggcagcugcugugggacacggucaccggcgugaacauggcccucuga

SEQ ID NO: 29219 - RNA, 1401 nt, Artificial Sequence; identical to SEQ ID NO: 28640
  derived and/or modified CDS sequence (AUadapt) from InfluenzaB__AGX15723__NA

SEQ ID NO: 29220 - RNA, 1401 nt, Artificial Sequence; identical to SEQ ID NO: 28640
  derived and/or modified CDS sequence (AUadapt) from InfluenzaB__AGX15745__NA

SEQ ID NO: 29221 - RNA, 1401 nt, Artificial Sequence; identical to SEQ ID NO: 28640
  derived and/or modified CDS sequence (AUadapt) from InfluenzaB__AGX15757__NA

SEQ ID NO: 29222 - RNA, 1401 nt, Artificial Sequence
  derived and/or modified CDS sequence (AUadapt) from InfluenzaB__AGX15768__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaacgugcaggccgugaaucgcuccgccaccaagggcgucacccuccugcugcccgagccggaguggaccuacccccggcucagcugccccggguccacguuccagaaggcccugcugaucucgccccaccgcuucggcgagaccaaggggaauuccgcgccgcucaucauccgggagcccuucaucgccugcggccccaacgagugcaagcacuucgcccugacccacuaugccgcgcagcccggcggguacuacaacggcacccgcggggaccggaacaagcugcgccaccucaucagugugaagcugggcaagaucccgacgguggagaacuccaucuuccacauggccgccuggagcggguccgccugccacgacggcaaggaguggaccuauaucggcgucgacgggcccgacaacaacgcccugcucaaggugaaguacggcgaggcguacaccgacaccuaucacucguacgccaacaagauccugcggacgcaggaguccgccugcaacugcaucgggggcaauugcuaccugaugaucaccgacggcagcgccagcgggguguccgagugccgcuuucucaagauccgggagggccgcaucaucaaggagaucuuccccaccgggcgggucaagcacaccgaggagugcacgugcggcuucgccucgaacaagaccaucgagugugcgugccgcgacaacuccuacaccgccaagcggcccuucgugaagcugaacguggagaccgacacggccgagauccgccugauguguaccgacaccuaccucgacaccccgcggcccaacgacgggagcaucacgggccccugcgaguccaauggcgacaaggggagcggcgggaucaagggcggguucguccaccagcgcauggaguccaagaucggccggugguacucgcgcaccauguccaagaccgagcggaugggcauggggcuguaugugaaguacgacggcgaccccugggccgacagcgacgcccuggcguucuccggggugaugaucaguaugaaggagccgggcugguacuccuucggguucgagaucaaggacaagaagugcgacguccccugcaucggcaucgagauggugcaugacggcgggaaggagaccuggcacagcgccgccacggccaucuacugccucaugggcuccgggcagcugcugugggacaccgugaccggcgucgacauggcccucuga

SEQ ID NO: 29223 - RNA, 1401 nt, Artificial Sequence
  derived and/or modified CDS sequence (AUadapt) from InfluenzaB__AGX15801__NA
augcugcccaguaccauccagacccucacgcuguuccugaccuccggcggggugcuccugagccuguacgucuccgccagccucuccuaccugcuguacucggauauccuccugaaguucuccccgaccgagaucaccgcccccacgaugagccuggacugcgugaacgcguccaacgugcaggccgucaaccgcagugccaccaagggcgugacccuccugcugcccgagcccgaguggaccuacccgcggcucuccugccccgggucgacguuccagaaggcccugcugaucagcccccaccgcuucggcgagaccaaggggaacuccgcgccccucaucauccgggagccguuuaucgccugcggccccaacgagugcaagcacuucgcccugacccacuacgccgcccagcccggcggguauuacaacggcacccgcggggaccggaacaagcugcgccaccucaucuccgugaagcugggcaagauccccacggucgagaacagcaucuuucacauggcggccugguccgggagcgccugccacgacggcaaggaguggaccuacaucggcguggacgggccggacaauaacgcccugcucaaggugaaguacggcgaggccuacaccgacaccuaccacuccuacgcgaauaagauccugcggacgcaggagucggccugcaacugcaucgggggcaacugcuaccugaugaucaccgauggcagcgccuccggggucagcgagugccgcuuccucaagauccgggagggccgcaucaucaaggagaucuuccccaccgggcgggugaagcacaccgaggagugcacgugcggcuuugccuccaacaagaccaucgagugcgccugccgcgacaacucguacaccgcgaagcggcccuuugugaagcugaacgucgagaccgacacggccgagauccgccugaugugcaccgacaccuaccucgacacgccccggccgaacgauggguccaucaccggccccugcgagagcaacggcgacaagggguccggcgggaucaagggcggguucgugcaccagcgcauggagagcaagaucggccggugguacucccgcaccaugaguaagaccgagcggaugggcauggggcuguacgugaaguacgacggcgaccccugggccgacuccgacgcccuggccuucaguggggucaugguguccaugaaggagcccggcugguacagcuucggguucgagaucaaggacaagaagugcgacgugccguguaucggcaucgagaugguccacgacggcgggaaggagaccuggcacuccgcggccacggccaucuacugccucaugggcagcgggcagcugcugugggacaccgugaccggcguggacauggcccucuga

SEQ ID NO: 29224 - RNA, 1401 nt, Artificial Sequence; identical to SEQ ID NO: 28640
  derived and/or modified CDS sequence (AUadapt) from InfluenzaB__AGX15812__NA

SEQ ID NO: 29225 - RNA, 1401 nt, Artificial Sequence; identical to SEQ ID NO: 28640
  derived and/or modified CDS sequence (AUadapt) from InfluenzaB__AGX15823__NA

SEQ ID NO: 29226 - RNA, 1401 nt, Artificial Sequence; identical to SEQ ID NO: 28662
  derived and/or modified CDS sequence (AUadapt) from InfluenzaB__AGX15845__NA

SEQ ID NO: 29227 - RNA, 1401 nt, Artificial Sequence; identical to SEQ ID NO: 28985
  derived and/or modified CDS sequence (AUadapt) from InfluenzaB__AGX15856__NA

SEQ ID NO: 29228 - RNA, 1401 nt, Artificial Sequence; identical to SEQ ID NO: 28662
  derived and/or modified CDS sequence (AUadapt) from InfluenzaB__AGX15867__NA

SEQ ID NO: 29229 - RNA, 1401 nt, Artificial Sequence; identical to SEQ ID NO: 28662
  derived and/or modified CDS sequence (AUadapt) from InfluenzaB__AGX15889__NA

SEQ ID NO: 29230 - RNA, 1401 nt, Artificial Sequence
  derived and/or modified CDS sequence (AUadapt) from InfluenzaB__AGX15900__NA
augcugcccaguaccauccagacccucacgcuguuccugaccuccggcggggugcuccugagccuguacgucuccgcccuccugagcuaccugcucuauuccgacauccugcugaaguucagcccgaccgagaucaccgcccccacgaugucccucgacugcgcgaacaccaguaacgugcaggccgugaaccgcuccgccaccaagggcgucaccuuccugcugcccgagcccgaguggacguacccgcggcucagcugccccggguccaccuuucagaaggcccugcugaucucgccccaccgcuucggcgagaccaaggggaacuccgcgccccucaucauccgggagccguucaucgccugcggccccaaugagugcaagcacuucgcccugacccacuacgccgcccagcccggcggguacuauaacggcacgcgcggggaccggaacaagcugcgccaccucaucagcgugaagcugggcaagauccccaccguggagaacuccaucuuucacauggcggccuggagcggguccgccugccacgacggcaaggaguggaccuacaucggcgucgaugggccggacaacgacgcccugcucaaggugaaguacggcgaggccuacaccgacacguaucacagcuacgcgaacaagauccugcggacccaggaguccgccugcaacuguaucgggggcaacugcuaccugaugaucaccgacggcagcgccagcgggguguccgagugucgcuuccucaagauccgggagggccgcaucaucaaggagaucuuccccaccgggcgggucaagcacacggaggagugcacgugcggcuucgccaguaacaagaccaucgagugcgccugccgcgacaacuccuacaccgcgaagcggcccuuugugaagcugaacguggagaccgacaccgccgagauccgccugaugugcaccgacaccuaccucgacacgccccggccggaugacgggagcaucaccggccccugcgaguccaacggcgacaaggggagcggcgggaucaagggcggguuuguccaccagcgcauggaguccaagaucggccggugguacagccgcaccauguccaagaccgagcggcgcggcauggggcuguacgugaaguacgacggcgaucccugggccgacagcgacgcccuggccuucuccggggugauggucagcaugaaggagcccggcugguacuccuuuggguucgagaucaaggacaagaagugcgacgugccgugcaucggcaucgagauggugcacgauggcgggaaggagacguggcacagcgcggccaccgccaucuacugccucaugggcuccgggcagcugcugugggacaccgucaccggcguggacauggcccucuga

SEQ ID NO: 29231 - RNA, 1401 nt, Artificial Sequence; identical to SEQ ID NO: 28662
  derived and/or modified CDS sequence (AUadapt) from InfluenzaB__AGX15911__NA

SEQ ID NO: 29232 - RNA, 1401 nt, Artificial Sequence
  derived and/or modified CDS sequence (AUadapt) from InfluenzaB__AGX15933__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccgcgaugccccuggacugcgccaacgccaguaacgugcaggccgugaaccgcuccgccacgaagggcgucacccuccugcugcccgagccggaguggaccuacccccggcucagcugccccggguccaccuuucagaaggcgcugcugaucucgccccaccgcuucggcgagacgaaggggaacuccgccccgcucaucauccgggagcccuucaucgccugcggccccaaugagugcaagcacuucgcccugacccacuacgcggcccagcccggcggguauuacaacggcacccgcggggaccggaacaagcugcgccaccucaucagcgugaagcugggcaagaucccgaccguggagaauuccaucuuccacauggccgccuggagcggguccgccugccacgauggcaaggaguggacguacaucggcgucgacgggcccgacaacaacgcgcugcucaaggugaaguacggcgaggccuauaccgacaccuaccacagcuacgccaauaagauccugcggacccaggaguccgccugcaacugcaucgggggcaacugcuaccugaugaucacggauggcagcgccagcgggguguccgagugccgcuuccucaagauccgggagggccgcaucaucaaggagaucuuccccaccgggcgggucaagcauaccgaggagugcacgugcggcuucgcgucgaacaagaccaucgagugcgccugucgcgacaacuccuacaccgccaagcggcccuucgugaagcugaacguggagaccgauaccgccgagauccgccugaugugcacggacaccuaccucgacaccccgcggcccaacgacgggaguaucaccggccccugcgaguccgacggcgacaaggggagcggcgggaucaagggcggguucguccaucagcgcauggaguccaagaucggccggugguacagccgcacgauguccaagaccgagcggaugggcauggggcuguacgugaaguacgacggcgaccccugggccgauagcgacgcgcuggccuucuccggggugauggucagcaugaaggagccgggcugguacuccuuuggguucgagaucaaggacaagaagugcgacgugcccugcaucggcaucgagauggugcacgauggcgggaaggagaccuggcacagcgccgccaccgccaucuacugccucaugggcuccgggcagcugcugugggacacggucaccggcguggacauggcgcucuga

SEQ ID NO: 29233 - RNA, 1401 nt, Artificial Sequence; identical to SEQ ID NO: 28662
  derived and/or modified CDS sequence (AUadapt) from InfluenzaB__AGX15944__NA

SEQ ID NO: 29234 - RNA, 1401 nt, Artificial Sequence; identical to SEQ ID NO: 29069
  derived and/or modified CDS sequence (AUadapt) from InfluenzaB__AGX15966__NA

SEQ ID NO: 29235 - RNA, 1401 nt, Artificial Sequence
  derived and/or modified CDS sequence (AUadapt) from InfluenzaB__AGX15988__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaacgaguguaagcacuucgcccugacccacuacgccgcgcagcccggcggguacuacaauggcacccgcggggaccggaacaagcugcgccaccucaucagcgugaagcugggcaagaucccgacgguggagaacuccaucuuccauauggccgccuggagcggguccgccugccacgacggcaaggaguggaccuacaucggcgucgacgggcccgauaacaacgcccugcucaaggugaaguacggcgaggcguacaccgacaccuaccauucguacgccaacaagauccugcggacgcaggaguccgccugcaacugcaucgggggcaauugcuaccugaugaucaccgacggcagcgccagcgggguguccgagugucgcuuccucaagauccgggagggccgcaucaucaaggagaucuuccccaccgggcgggucaagcacaccgaggagugcacgugcggcuucgccaguaacaagaccaucgagugcgcgugccgcgacaacuccuacaccgccaagcggcccuuugugaagcugaacguggagaccgacacggccgagguccgccugaugugcaccgacaccuaccucgacaccccgcggcccaaugacgggagcaucacgggccccugcgaguccgacggcgacaaggggucgggcgggaucaagggcggguuugugcaccagcgcauggaguccaagaucggccggugguacagccgcaccauguccaagaccgagcggaugggcauggggcuguacgugaaguacgacggcgaucccugggccgacagcgacgcccugaccuucuccggggucauggugagcaugaaggagccgggcugguacuccuuuggguucgagaucaaggacaagaagugcgacgugcccugcaucggcaucgagaugguccacgauggcgggaaggagacguggcacagcgcggccaccgccaucuacugccucaugggcuccgggcagcugcugugggacaccgugaccggcguggacauggcccucuga

SEQ ID NO: 29236 - RNA, 1401 nt, Artificial Sequence; identical to SEQ ID NO: 29069
  derived and/or modified CDS sequence (AUadapt) from InfluenzaB__AGX15999__NA

SEQ ID NO: 29237 - RNA, 1401 nt, Artificial Sequence; identical to SEQ ID NO: 29069
  derived and/or modified CDS sequence (AUadapt) from InfluenzaB__AGX16010__NA

SEQ ID NO: 29238 - RNA, 1401 nt, Artificial Sequence; identical to SEQ ID NO: 29069
  derived and/or modified CDS sequence (AUadapt) from InfluenzaB__AGX16021__NA

SEQ ID NO: 29239 - RNA, 1401 nt, Artificial Sequence
  derived and/or modified CDS sequence (AUadapt) from InfluenzaB__AGX16032__NA
augcugcccaguaccauccagacccucacgcuguuccugaccuccggcggggugcuccugagccuguacgucuccgccagccucuccuaccugcuguacagugacauccuccugaaguucucccagaccgagaucaccgccccgaucaugccccuggacugcgcgaacgccagcaaugugcaggccgugaaccgcuccgccacgaagggcgucacccuccugcugcccgagcccgaguggaccuacccgcggcucagcugccccggguccaccuuccagaaggcccugcugaucagcccccaucgcuucggcgagacgaaggggaacuccgcgccccucaucauccgggagccguucaucgccugcggccccaaggagugcaagcacuuugcccugacccacuacgccgcgcagcccggcggguacuacaacggcacccgcgaggaccggaauaagcugcgccaccucaucucggugaagcuggggaagauccccaccguggagaacuccaucuuccacauggccgccuggagcggcuccgccugucacgacgggaaggaguggacguacaucggcgucgacggcccggacagcaaugcccugcucaagaucaaguacggggaggcguacaccgacaccuaccacuccuacgccaagaauauccugcggacccaggagagcgccugcaacugcaucggcggggacugcuaucugaugaucacggacggccccgccucgggcaucuccgagugccgcuuccucaagauccgggaggggcgcaucaucaaggagaucuuccccaccggccgggugaagcacaccgaggaguguacgugcggguucgccagcaacaagaccaucgagugcgcgugccgcgauaacuccuacaccgccaagcggcccuucgugaagcugaacgucgagaccgacaccgccgagauccgccugaugugcacggagaccuaucucgacaccccgcggcccaacgacggcagcaucaccgggcccugcgaguccgacggcgauaagggcagcgggggcaucaagggcggguucgugcaccagcgcauggccuccaagaucgggcggugguacucgcgcacgauguccaagaccaagcggaugggcaugggccuguacgugaaguaugacggggaccccuggaccgacagcgaggcccuggcgcucuccggcgucauggugagcauggaggagccggggugguacuccuuuggcuucgagaucaaggacaagaagugcgacgugcccugcaucgggaucgagaugguccacgauggcggcaagaccacguggcacagcgccgccaccgccaucuacugccugaugggguccggccagcugcucugggacaccgugaccgggguggacauggcccuguga

SEQ ID NO: 29240 - RNA, 1401 nt, Artificial Sequence; identical to SEQ ID NO: 28856
  derived and/or modified CDS sequence (AUadapt) from InfluenzaB__AGX16043__NA

SEQ ID NO: 29241 - RNA, 1401 nt, Artificial Sequence; identical to SEQ ID NO: 28858
  derived and/or modified CDS sequence (AUadapt) from InfluenzaB__AGX16054__NA

SEQ ID NO: 29242 - RNA, 1401 nt, Artificial Sequence
  derived and/or modified CDS sequence (AUadapt) from InfluenzaB__AGX16087__NA
augcugcccaguaccauccagacccucacgcuguuccugaccuccggcggggugcuccugagccuguacgucuccgccagccucuccuaccugcuguacagugacauccuccugaaguucucccagaccgagaucaccgccccgaucaugccccuggacugcgcgaacgccagcaaugugcaggccgugaaccgcuccgccacgaagggcgucacccuccugcugcccgagcccgaguggaccuacccgcggcucagcugccccggguccaccuuccagaaggcccugcugaucucgccccaucgcuucggcgagacgaaggggaacuccgcgccccucaucauccgggagccguucaucgccugcggccccaaggagugcaagcacuuugcccugacccacuacgccgcgcagcccggcggguacuacaacggcacccgcgaggaccggaauaagcugcgccaccucaucagcgugaagcuggggaagauccccaccguggagaacuccaucuuccacauggccgccuggagcggcuccgccugucacgacgggcgggaguggacguacaucggcgucgacggcccggacucgaaugcccugcucaagaucaaguacggggaggcguacaccgacaccuaccacuccuacgccaagaauauccugcgcacccaggagagcgccugcaacugcaucggcggggacugcuaucugaugaucacggacggccccgccagcggcaucuccgagugccgguuccucaagauccgcgaggggcggaucaucaaggagaucuuccccaccggccgcgugaagcacaccgaggaguguacgugcggguucgccucgaacaagaccaucgagugcgcgugccgggauaacaacuacaccgccaagcgccccuucgugaagcugaacgucgagaccgacaccgccgagauccggcugauguguacggagaccuaccucgacaccccgcgccccaacgacggcuccaucaccgggcccugcgagagcaauggcgacaagggcuccgggggcaucaagggcggguucgugcaccagcggauggccagcaagaucgggcgcugguacucccggacgaugucgaagaccaagcgcaugggcaugggccuguaugugaaguacgacggggaccccuggaccgacuccgaggcccuggcgcucagcggcgucaugguguccauggaggagccggggugguacaguuucggcuucgagaucaaggacaagaagugcgacgugcccugcaucgggaucgagaugguccaugacggcggcaagaccacguggcacuccgccgccaccgccaucuacugccugauggggagcggccagcugcucugggacaccgugaccgggguggacauggcccuguga

SEQ ID NO: 29243 - RNA, 1401 nt, Artificial Sequence
  derived and/or modified CDS sequence (AUadapt) from InfluenzaB__AGX16109__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgacgaugccccuggauugcgcgaacgccagcaacgugcaggccgugaaccgcuccgccaccaagggcgucacccuccugcugcccgagcccgaguggaccuauccgcggcucagcugccccggguccacguuccagaaggcccugcugaucagcccccaucgcuucggcgagaccaaggggaacuccgcgccccucaucauccgggagccguucaucgccugcggccccaaggagugcaagcauuucgcccugacccacuacgccgcgcagcccggcggguacuauaacggcacccgcgaggaccggaacaagcugcgccaccucaucagugugaagcuggggaagauccccacgguggagaacuccaucuuccacauggccgccuggagcggcuccgccugccaugacgggcgggaguggaccuacgucggcguggacggcccggacaguaacgcccugcucaagaucaaguacggggaggcguacaccgacaccuaccauuccuacgccaagaacauccugcgcacgcaggagagcgccugcaauugcaucggcggggacugcuaccugaugaucaccgauggccccgccagcggcaucuccgagugccgguuccucaagauccgcgaggggcggaucaucaaggagaucuuccccaccggccgcgugaagcacaccgaggaguguacgugcggguucgccagcaacaagaccaucgagugugcgugccgggacaacuccuacaccgccaagcgccccuucgucaagcuggauguggagaccgacacggccgagauccggcugaugugcaccgagaccuaccucgacaccccgcgccccaaugacggcagcaucacggggcccugcgaggccaacggcgauaagggcuccgggggcaucaagggcggguucgugcaccagcggauggccagcaagaucgggcgcugguacucccggaccaugagcaagaccaagcgcaugggcaugggccuguaugucaaguacgacggggaccccuggaccgacuccgaggcgcuggcccucaguggcgugaugguguccauggaggagccggggugguacagcuucggcuucgagaucaaggacaagaagugugacguccccugcaucgggaucgagauggugcacgacggcggcaagacgaccuggcauuccgccgccaccgccaucuacugccugauggggagcggccagcugcucugggacaccgugacgggggucgacauggcgcuguga

SEQ ID NO: 29244 - RNA, 1401 nt, Artificial Sequence
  derived and/or modified CDS sequence (AUadapt) from InfluenzaB__AGX16120__NA
augcugcccaguaccauccagacccucacgcuguuccugaccuccggcggggugcuccugagccuguacgucuccgccucgcucuccuaccugcuguacagcgauauccuccugaaguucuccaccaccgagaucacggccccgaccaugccccuggacugcgcgaacgccagcaacgugcaggccgugaaccgcuccgccaccaagggcgucaccuuccuccugcccgagcccgaguggacguauccgcggcugucgugccccggguccaccuuccagaaggcccuccugaucagcccccaccgcuucggcgagaccaaggggaacuccgcgccccugaucauccgggagccguucaucgccuguggccccaaggagugcaagcacuucgcccucacccacuacgccgcgcagcccggcggguacuacaacggcacgcgcgaggaucggaacaagcugcgccaccugaucucggugaagcucgggaagauccccaccguggagaacuccaucuuccacauggccgccuggagcggcuccgccugucacgacgggaaggaguggaccuacaucggcgucgacggcccggacagcaacgcccugcugaagaucaaguacggggaggcguauaccgacacguaccacuccuacgccaacaacauccuccggacccaggagucggccugcaauugcaucggcgggaacugcuaccugaugaucaccgacggcagcgccuccggcaucucggagugccgcuuucugaagauccgggaggggcgcaucaucaaggagaucuuccccaccggccgggugaagcacacggaggagugcacgugcggguucgccuccaacaagaccaucgagugcgcgugccgcgauaacagcuacaccgccaagcggcccuucgugaagcucaacgucgagaccgacaccgccgagauccgccugaugugcaccgagaccuaucuggacacgccccggccggacgacggcuccaucaccgggcccugcgagagcaacggcaacaagggcuccgggggcaucaagggcggguucgugcaucagcgcauggccucgaagaucgggcggugguacucccgcaccaugagcaagaccaagcggaugggcaugggccucuacgugaaguacgacggggaccccuggacggacuccgaugcccuggcgcugucgggcgucaugguguccauggaggagcccgggugguacagcuucggcuucgagaucaaggacaagaagugcgacgugccguguaucgggaucgagaugguccacgacggcggcaaggagaccuggcacuccgccgccaccgccaucuacugccucauggggagcggccagcugcugugggacaccgugacggggguggacauggcccucuga

SEQ ID NO: 29245 - RNA, 1401 nt, Artificial Sequence; identical to SEQ ID NO: 29244
  derived and/or modified CDS sequence (AUadapt) from InfluenzaB__AGX16131__NA

SEQ ID NO: 29246 - RNA, 1401 nt, Artificial Sequence; identical to SEQ ID NO: 29244
  derived and/or modified CDS sequence (AUadapt) from InfluenzaB__AGX16142__NA

SEQ ID NO: 29247 - RNA, 1401 nt, Artificial Sequence
  derived and/or modified CDS sequence (AUadapt) from InfluenzaB__AGX16153__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaaugccagcaacgugcaggccgugaaccgcuccgccacgcggggcgucacccuccugcugcccgagcccgaguggaccuacccgcgccucagcugucccggguccaccuuccagaaggcccugcugaucucgccccaccgguucggcgagacgaaggggaacuccgcgccccucaucauccgcgagccguucaucgccuguggccccaaggagugcaagcacuucgcccugacccacuacgccgcgcagcccggcggguauuacaacggcacccgggaggaccgcaacaagcugcggcaccucaucagugugaagcuggggaagauccccaccguggagaacuccaucuuccacaugacggccuggagcggcuccgccugccaugacgggcgcgaguggaccuacaucggcgucgacggcccggacagcaacgcccugcucaagaucaaguauggggaggccuacaccgacaccuaccacuccuacgcgaagaauauccugcggacgcaggagagcgccugcaacugcaucggcggggacuguuaccugaugaucaccgacggccccgccagcggcaucuccgagugccgcuuccucaagauccgggaggggcgcaucaucaaggagaucuuucccaccggccgggugaagcacaccgaggagugcacgugcggguucgccucgaacaagaccaucgagugugccugccgcgacaacuccuacaccgcgaagcggcccuucgugaagcugaaugucgagaccgacacggccgagauccgccugaugugcaccgagaccuaccucgacaccccgcggcccaacgauggcagcaucacggggcccugcgaguccaacggcgacaagggcagcgggggcaucaagggcggguuugugcaccagcgcauggccuccaagaucgggcggugguacagccgcaccauguccaagaccaagcggaugggcaugggccuguacgugaaguacgacggggaucccuggaccgacagcgaggcccuggcccucuccggcgucauggugagcauggaggagccggggugguacuccuucggcuuugagaucaaggacaagaagugcgacgugcccugcaucgggaucgagaugguccacgauggcggcaagacgaccuggcacagcgcggccaccgccaucuacugccugaugggguccggccagcugcucugggacaccgugacggggguggacauggcccuguga

SEQ ID NO: 29248 - RNA, 1401 nt, Artificial Sequence; identical to SEQ ID NO: 29242
  derived and/or modified CDS sequence (AUadapt) from InfluenzaB__AGX16164__NA

SEQ ID NO: 29249 - RNA, 1401 nt, Artificial Sequence; identical to SEQ ID NO: 28901
  derived and/or modified CDS sequence (AUadapt) from InfluenzaB__AGX16197__NA

SEQ ID NO: 29250 - RNA, 1401 nt, Artificial Sequence; identical to SEQ ID NO: 28901
  derived and/or modified CDS sequence (AUadapt) from InfluenzaB__AGX16208__NA

SEQ ID NO: 29251 - RNA, 1401 nt, Artificial Sequence; identical to SEQ ID NO: 28901
  derived and/or modified CDS sequence (AUadapt) from InfluenzaB__AGX16219__NA

SEQ ID NO: 29252 - RNA, 1401 nt, Artificial Sequence; identical to SEQ ID NO: 28740
  derived and/or modified CDS sequence (AUadapt) from InfluenzaB__AGX16230__NA

SEQ ID NO: 29253 - RNA, 1401 nt, Artificial Sequence
  derived and/or modified CDS sequence (AUadapt) from InfluenzaB__AGX16241__NA
augcugcccaguaccauccagacccucacgcuguuccugaccuccggcggggugcuccugagccuguacgucuccgccagccucuccuaccugcuguacucggauauccuccugaaguucucccagaccgagaucaccgccccgaucaugccccuggacugcgcgaacgccagcaacgugcaggccgugaaccauuccgccacgaagggcgucacccuccugcugcccgagcccgaguggaccuacccgcgccucagcugccccggguccaccuuccagaaggcccugcugaucucgccccaccgguucggcgagacgaaggggaauuccgcgccccucaucauccgcgagccguucaucgccugcggccccaaggagugcaagcacuucgcccugacccacuacgccgcgcagcccggcggguauuacaacggcacccgggaggaccgcaacaagcugcggcaccucaucagcgugaagcuggggaagauccccaccguggagaacuccaucuuucacauggccgccuggagcggcuccgccugccacgacgggcgcgaguggacguacaucggcgucgacggcccggauucgaacgcccugcucaagaucaaguacggggaggcguacaccgacaccuaccacuccuaugccaagaacauccugcggacccaggagagcgccugcaacugcaucggcggggacugcuaucugaugaucacggacggccccgccagcggcaucuccgagugccgcuuccucaagauccgggaggggcgcaucaucaaggagaucuuccccaccggccgggugaagcacaccgaggagugcacguguggguucgccucgaacaagaccaucgagugcgcgugccgcgacaacuccuauaccgccaagcggcccuucgugaagcugaacgucgagaccgacaccgccgagauccgccugaugugcacggagaccuaccucgacaccccgcggcccaacgauggcagcaucaucgggcccugcgaguccaacggcgacaagggcagcgggggcaucaagggcggguucgugcaccagcgcauggccuccaagaucgggcggugguauucgcgcaccauguccaagacgaagcggaugggcaugggccuguacgugaaguacgacggggaccccuggaccgacagcgaggcccugacccucuccggcgucauggugaguauggaggagccggggugguacuccuucggcuucgagaucaaggacaagaagugcgacgugcccugcaucgggaucgagaugguccaugacggcggcaagaccacguggcacagcgcggccaccgccaucuacugccugaugggguccggccagcugcucugggacaccgugaccgggguggacauggcccuguga

SEQ ID NO: 29254 - RNA, 1401 nt, Artificial Sequence
  derived and/or modified CDS sequence (AUadapt) from InfluenzaB__AGX16252__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgaucaugccccuggacugugcgaacgccagcaacgugcaggccgugaaccgcuccgccgccaagggcgucacgcuccugcugcccgagcccgagugggcguacccgcggcucaguugccccggguccaccuuccagaaggcccugcugaucagcccccaccgcuuuggcgagaccaaggggaacuccgcgccccucaucauccgggagccguucaucgccugcggccccaccgagugcaagcacuuugcccugacgcacuacgccgcccagcccggcggguacuacaacggcacccgcgaggaucggaacaagcugcgccaccucaucagcgugaagcuggggaagauccccaccguggagaacuccaucuuucacauggccgccuggagcggcuccgcgugccacgacgggaaggaguggaccuauaucggcgucgacggcccggacucgaacgcccugcucaagaucaaguacggggaggccuauacggacaccuaccacuccuacgccaagaauauccugcggacccaggagagcgccugcaacugcaucggcggggacuguuaccugaugaucaccgacggccccgcgagcggcaucuccgagugccgcuuccucaagauccgggaggggcgcaucaucaaggagaucuuucccacgggccgggugaagcacaccgaggagugcacgugcggguucgccaguaacaagaccaucgagugcgccugccgcgacaaccgguauaccgccaagcgccccuucgugaagcugaacgucgagaccgacaccgccgagauccggcugaugugcaccgagacguaccucgauaccccgcgccccaacgacggcuccaucaccgggcccugcgagagcgauggcgacaagggcuccgggggcaucaagggcggguucgugcaccagcggauggcgagcaagaucgggcgcugguacucccggaccaugaguaagacgaagcgcaugggcaugggccuguacgugaaguacgacggggaccccuggaccgacuccgaggcccuggcccucaguggcgucaugguguccauggaggagccggggugguacagcuucggcuucgagaucaaggauaagaagugcgacgugcccugcaucgggaucgagaugguccacgacggcggcaagaccaccuggcauuccgccgccacggcgaucuacugccugauggggagcggccagcugcucugggacaccgugaccgggguggacauggcccuguga

SEQ ID NO: 29255 - RNA, 1401 nt, Artificial Sequence; identical to SEQ ID NO: 28901
  derived and/or modified CDS sequence (AUadapt) from InfluenzaB__AGX16274__NA

SEQ ID NO: 29256 - RNA, 1401 nt, Artificial Sequence
  derived and/or modified CDS sequence (AUadapt) from InfluenzaB__AGX16285__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgaucaugccccuggacugugcgaacgccagcaacgugcaggccgugaaccgcuccgccgccaagggcgucacgcuccugcugcccgagcccgaguggaccuacccgcggcucaguugccccggguccaccuuccagaaggcgcugcugaucucgccccaccgcuucggcgagaccaaggggaauuccgcgccccucaucauccgggagccguucaucgccugcggccccacggagugcaagcacuucgcccugacccauuacgccgcccagcccggcggguacuacaacggcacccgcgaggaccggaauaagcugcgccaccucaucagcgugaagcuggggaagauccccaccguggagaacuccaucuuccacauggccgccuggaguggcuccgccugccacgacgggaaggaguggacguacaucggcgucgacggcccggauagcaacgcgcugcucaagaucaaguacggggaggccuacaccgacaccuaucacuccuacgccaagaacauccugcggacccaggagagcgccugcaauugcaucggcggggacugcuaccugaugaucacggacggccccgccaguggcaucuccgagugccgcuuccucaagauccgggaggggcgcaucaucaaggagaucuuccccaccggccgggugaagcacaccgaggagugcacguguggguucgcgucgaacaagaccaucgagugcgccugccgcgauaacuccuacaccgccaagcggcccuucgugaagcugaacgucgagaccgacaccgccgagauccgccugauguguacggagaccuaccucgacaccccgcggcccaacgacggcagcaccacggggcccugugaguccgacggcgacaagggcagcgggggcaucaagggcggguucgugcaccagcgcauggccuccaagaucgggcggugguauagccgcaccauguccaagaccaagcggaugggcaugggccuguacgugaaguacgacggggaccccuggaccgauagcgaggcgcuggcccucuccggcgucauggugagcauggaggagccggggugguacuccuucggcuucgagaucaaggauaagaagugcgacgugcccugcaucgggaucgagaugguccacgacggcggcaagacgaccuggcauagcgccgccaccgccaucuacugccugaugggguccggccagcugcucugggacaccgugacggggguggacauggcgcuguga

SEQ ID NO: 29257 - RNA, 1401 nt, Artificial Sequence; identical to SEQ ID NO: 28901
  derived and/or modified CDS sequence (AUadapt) from InfluenzaB__AGX16296__NA

SEQ ID NO: 29258 - RNA, 1401 nt, Artificial Sequence; identical to SEQ ID NO: 28748
  derived and/or modified CDS sequence (AUadapt) from InfluenzaB__AGX16307__NA

SEQ ID NO: 29259 - RNA, 1401 nt, Artificial Sequence; identical to SEQ ID NO: 28901
  derived and/or modified CDS sequence (AUadapt) from InfluenzaB__AGX16329__NA

SEQ ID NO: 29260 - RNA, 1401 nt, Artificial Sequence
  derived and/or modified CDS sequence (AUadapt) from InfluenzaB__AGX16362__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgaucaugccccuggacugugcgaacgccagcaacgugcaggccgugaaccgcuccgccgccaagggcgucacgcuccugcugcccgagcccgaguggaccuacccgcggcucaguugccccggguccaccuuccagaaggcgcugcugaucagcccccaccgcuucggcgagaccaaggggaauuccgcgccccucaucauccgggagccguucaucgccugcggccccacggagugcaagcacuucgcccugacccauuacgccgcccagcccggcggguacuacaacggcacccgcgaggaccggaauaagcugcgccaccucaucagcgugaagcuggggaagauccccaccguggagaacuccaucuuccacauggccgccuggaguggcuccgccugccacgacgggaaggaguggacguacaucggcgucgacggcccggauucgaacgcgcugcucaagaucaaguacggggaggccuacaccgacaccuaucacuccuacgccaagaacauccugcggacccaggagagcgccugcaauugcaucggcggggacugcuaccugaugaucacggacggccccgccaguggcguguccgagugccgcuuccucaagauccgggaggggcgcaucaucaaggagaucuuccccaccggccgggugaagcacaccgaggagugcacguguggguucgcgagcaacaagaccaucgagugcgccugccgcgauaacuccuacaccgccaagcggcccuucgucaagcugaacguggagaccgacaccgccgagauccgccugauguguacggagaccuaccucgacaccccgcggcccaacgacggcagcaucaccgggcccugugaguccgacggcgacaagggcagcgggggcaucaagggcggguucgugcaccagcgcauggccuccaagaucgggcggugguauagccgcacgauguccaagaccaagcggaugggcaugggccuguacgucaaguacgacggggaccccuggaccgauagcgaggcgcuggcccucuccggcgugauggugagcauggaggagccggggugguacuccuucggcuucgagaucaaggauaagaagugcgacguccccugcaucgggaucgagauggugcacgacggcggcaagaccacguggcauagcgccgccaccgccaucuacugccugaugggguccggccagcugcucugggacaccgugaccggggucgacauggcgcuguga

SEQ ID NO: 29261 - RNA, 1401 nt, Artificial Sequence; identical to SEQ ID NO: 29073
  derived and/or modified CDS sequence (AUadapt) from InfluenzaB__AGX16373__NA

SEQ ID NO: 29262 - RNA, 1401 nt, Artificial Sequence
  derived and/or modified CDS sequence (AUadapt) from InfluenzaB__AGX16384__NA
augcugcccaguaccauccagacccucacgcuguuccugaccuccggcggggugcuccugagccuguacgucuccgccagccucuccuaccugcuguacagugacauccuccugaaguucucccagaccgagaucaccgccccgaucaugccccuggacugcgcgaacgccagcaaugugcaggccgugaaccgcuccgccgccaagggcgucacgcuccugcugcccgagcccgaguggaccuacccgcggcucagcugccccggguccaccuuccagaaggcgcugcugaucagcccccaucgcuucggcgagaccaaggggaacuccgcgccccucaucauccgggagccguucaucgccugcggccccacggagugcaagcacuuugcccugacccacuacgccgcccagcccggcggguacuacaacggcacccgcgaggaccggaauaagcugaagcaccucaucucggugaagcuggggaagauccccaccguggagaacuccaucuuccacauggccgccuggagcggcuccgccugucacgacgggaaggaguggacguacaucggcgucgacggcccggacagcaaugcgcugcucaagaucaaguacggggaggccuacaccgacaccuaccacuccuacgccaagaauauccugcgcacccaggagagcgccugcaacugcaucggcggggacugcuaucugaugaucacggacggccccgccucgggcaucuccgagugccgguuccucaagauccgcgaggggcggaucaucaaggagaucuuccccaccggccgcgugaagcacaccgaggaguguacgugcggguucgcgagcaacaagaccaucgagugcgccugccgggauaacuccuacaccgccaagcgccccuucgugaagcugaacgucgagaccgacaccgccgagauccggcugaugugcacggagaccuaucucgacaccccgcgccccaacgacggcagcaucaccgggcccugcgaguccgacggcgauaagggcagcgggggcaucaagggcggguucgugcaccagcggauggccuccaagaucgggcgcugguacucgcggacgauguccaagaccaagcgcaugggcaugggccuguacgugaaguaugacggggaccccuggaccgacagcgaggcgcuggcccucuccggcgucauggugagcauggaggagccggggugguacuccuuuggcuucgagaucaaggacaagaagugcgacgugcccugcaucgggaucgagaugguccacgauggcggcaagaccacguggcacagcgccgccaccgccaucuacugccugaugggguccggccagcugcucugggacaccgugaccgggguggacauggcgcuguga

SEQ ID NO: 29263 - RNA, 1401 nt, Artificial Sequence; identical to SEQ ID NO: 28686
  derived and/or modified CDS sequence (AUadapt) from InfluenzaB__AGX16406__NA

SEQ ID NO: 29264 - RNA, 1401 nt, Artificial Sequence; identical to SEQ ID NO: 28686
  derived and/or modified CDS sequence (AUadapt) from InfluenzaB__AGX16427__NA

SEQ ID NO: 29265 - RNA, 1401 nt, Artificial Sequence; identical to SEQ ID NO: 28686
  derived and/or modified CDS sequence (AUadapt) from InfluenzaB__AGX16438__NA

SEQ ID NO: 29266 - RNA, 1401 nt, Artificial Sequence; identical to SEQ ID NO: 28686
  derived and/or modified CDS sequence (AUadapt) from InfluenzaB__AGX16449__NA

SEQ ID NO: 29267 - RNA, 1401 nt, Artificial Sequence; identical to SEQ ID NO: 28686
  derived and/or modified CDS sequence (AUadapt) from InfluenzaB__AGX16460__NA

SEQ ID NO: 29268 - RNA, 1401 nt, Artificial Sequence
  derived and/or modified CDS sequence (AUadapt) from InfluenzaB__AGX16471__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgaucaugccccuggacugugcgaacgccagcaacgugcaggccgugaaccgcuccgccgccaagggcgucacgcuccugcugcccgagcccgaguggaccuacccgcggcucaguugccccggguccaccuuccagaaggcgcugcugaucagcccccaccgcuucggcgagaccaaggggaauuccgcgccccucaucauccgggagccguucaucgccugcggccccacggagugcaagcacuucgcccugacccauuacgccgcccagcccggcggguacuacaacggcacccgcgaggaccggaauaagcugcgccaccucaucagcgugaagcuggggaagauccccaccguggagaacuccaucuuccacauggccgccuggaguggcuccgccugccacgacgggaaggaguggacguacaucggcgucgacggcccggauucgaacgcgcugcucaagaucaaguacggggaggccuacaccgacaccuaucacuccuacgccaagaacauccugcggacccaggagagcgccugcaauugcaucggcggggacugcuaccugaugaucacggacggccccgccaguggcaucuccgagugccgcuuccucaagauccgggaggggcgcaucaucaaggagaucuuccccaccggccgggugaagcacaccgaggagugcacguguggguucgcgagcaacaagaccaucgagugcgccugccgcgauaacuccuacaccgccaagcggcccuucgugaagcugaacgucgagaccgacaccgccgagauccgccugauguguacgaagaccuaccucgacaccccgcggcccaacgacggcagcaucaccgggcccugugaguccgacggcgacaagggcagcgggggcaucaagggcggguucgugcaccagcgcauggccuccaagaucgggcggugguauagccgcacgauguccaagacccggcgcaugggcaugggccuguacgugaaguacgacggggaccccuggaccgauagcgaggcgcuggcccucuccggcgucauggugagcauggaggagccggggugguacuccuucggcuucgagaucaaggauaagaagugcgacgugcccugcaucgggaucgagaugguccacgacggcggcaagaccacguggcauagcgccgccaccgccaucuacugccugaugggguccggccagcugcucugggacaccgugaccgggguggacauggcgcuguga

SEQ ID NO: 29269 - RNA, 1401 nt, Artificial Sequence; identical to SEQ ID NO: 28686
  derived and/or modified CDS sequence (AUadapt) from InfluenzaB__AGX16482__NA

SEQ ID NO: 29270 - RNA, 1401 nt, Artificial Sequence
  derived and/or modified CDS sequence (AUadapt) from InfluenzaB__AGX16493__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgaucaugccccuggacugugcgaacgccagcaacgugcaggccgugaaccgcuccgccgccaagggcgucacgcuccugcugcccgagcccgaguggaccuacccgcggcucaguugccccggguccaccuuccagaaggcgcugcugaucagcccccaccgcuucggcgagaccaaggggaauuccgcgccccucaucauccgggagccguucaucgccugcggccccacggagugcaagcacuucgcccugacccauuacgccgcccagcccggcggguacuacaacggcacccgcgaggaccggaauaagcugcgccaccucaucagcgugaagcuggggaagauccccaccguggagaacuccaucuuccacauggccgccuggaguggcuccgccugccacgacgggaaggaguggacguacaucggcgucgacggcccggauucgaacgcgcugcucaagaucaaguacggggaggccuacaccgacaccuaucacuccuacgccaagaacauccugcggacccaggagagcgccugcaauugcaucggcggggacugcuaccugaugaucacggacggccccgccaguggcaucuccgagugccgcuuccucaagauccgggaggggcgcaucaucaaggagaucuuccccaccggccgggugaagcacaccgaggagugcacguguggguucgcgagcaacaagaccaucgagugcgccugccgcgauaacuccuacaccgccaagcggcccuucgugaagcugaacgucgagaccgacaccgccgagauccgccugauguguacggagaccuaccucgacaccccgcggcccaacgacggcagcaucaccgggcccugugaguccgacggcgacaagggcagcgggggcaucaagggcggguucgugcaccagcgcauggccuccaagaucgggcggugguauagccgcacgauguccaagaccaagcggaugggcaugggccuguacgugaaguacgacggggaccccuggaccgauagcgaggcgcuggcccucuccggcgucguggugagcauggaggagccggggugguacuccuucggcuucgagaucaaggauaagaagugcgacguccccugcaucgggaucgagauggugcacgacggcggcaagaccacguggcauagcgccgccaccgccaucuacugccugaugggguccggccagcugcucugggacaccgugaccggggucgacauggcgcuguga

SEQ ID NO: 29271 - RNA, 1401 nt, Artificial Sequence; identical to SEQ ID NO: 28729
  derived and/or modified CDS sequence (AUadapt) from InfluenzaB__AGX16504__NA

SEQ ID NO: 29272 - RNA, 1401 nt, Artificial Sequence; identical to SEQ ID NO: 28729
  derived and/or modified CDS sequence (AUadapt) from InfluenzaB__AGX16515__NA

SEQ ID NO: 29273 - RNA, 1401 nt, Artificial Sequence
  derived and/or modified CDS sequence (AUadapt) from InfluenzaB__AGX16548__NA
augcugcccaguaccauccagacccucacgcuguuccugaccuccggcggggugcuccugagccuguacgucuccgccagccucuccuaccugcuguauucggacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaaggagugcaagcauuucgcccugacccacuacgccgcgcagcccggcggguacuacaacggcacccgcggggaucggaacaagcugcgccaccucaucucggugaagcugggcaagaucccgacgguggagaacuccaucuuccacauggccgccuggaguggguccgccugccacgacggcaaggaguggaccuacaucggcgucgacgggcccgauaacaacgcccugcucaagaucaaguacggcgaggcguacaccgacaccuaccauagcuacgccaacaacauccugcggacgcaggaguccgccugcaacuguaucgggggcaacugcuaccugaugaucaccgacggcagcgccucggggaucuccgagugucgcuuccucaagauccgggagggccgcaucaucaaggagaucuuccccaccgggcgggugaagcacaccgaggagugcacgugcggcuucgccaguaacaagaccaucgagugcgcgugccgcgacaacuccuacaccgccaagcggcccuuugugaagcugaacgucgagaccgacacggccgagauccgccugaugugcaccgagaccuaccucgacaccccgcggcccgaugacgggagcaucacgggccccugcgaguccaacggcgacaacgggaguggcgggaucaagggcggguucgugcaccagcgcauggccuccaagaucggccggugguacucgcgcaccauguccaagaccaagcggaugggcauggggcuguacgugaaguacgauggcgaccccugggccgacagcgacgcgcuggcccucuccggggucauggugagcauggaggagccgggcugguacuccuuuggguucgagaucaaggacaagaagugcgacgugcccugcaucggcaucgagaugguccacgauggcgggaaggagaccuggcacagcgccgccacggccaucuacugccugaugggcuccgggcagcugcucugggacaccgugaccggcguggacauggcgcuguga

SEQ ID NO: 29274 - RNA, 1401 nt, Artificial Sequence
  derived and/or modified CDS sequence (AUadapt) from InfluenzaB__AGX16559__NA
augcugcccaguaccauccagacccucacgcuguuccugaccuccggcggggugcuccugagccuguacgucuccgccagccucuccuaccugcuguauagcgacauccuccugaaguucuccccgaccgagaucaucgcccccaccaugccccuggacugcgcgaaugccagcaacgugcaggccgugaaccgcuccgccacgaagggcgucacccuccugcugcccgagccggaguggaccuacccccggcucagcugccccggguccaccuuucagaaggcccugcugaucucgccccaccgcuucggcgagacgaaggggaacuccgcgccgcucaucauccgggagcccuucaucgccuguggccccaaggagugcaagcacuucgcccugacccacuacgccgcgcagcccggcggguacuauaacggcacccgcggggaccggaacaagcugcgccaccucaucagcgugaagcugggcaagaucccgaccguggagaauuccaucuuccacauggccgccuggagcggguccgccugccacgauggcaaggaguggacguacaucggcgucgacgggcccgacaacaacgcccugcucaagaucaaguacggcgaggcguauaccgacaccuaccacagcuacgccaauaacauccugcggacccaggaguccgccugcaacugcaucgggggcaacugcuaucugaugaucacggacggcagcgccagcgggaucuccgagugccgcuuccucaagauccgggagggccgcaucaucaaggagaucuuucccaccgggcgggugaagcacaccgaggagugcacgugcggcuucgccucgaacaagaccaucgagugugcgugccgcgacaacuccuacaccgccaagcggcccuucgugaagcugaaugucgagaccgacaccgccgagauccgccugaugugcacggagaccuaccucgacaccccgcggcccgacgaugggagcaucaccggccccugcgaguccaacggcgacaaggggagcggcgggaucaagggcggguucgugcaucagcgcauggccuccaagaucggccggugguacagccgcacgauguccaagaccaagcggaugggcauggggcuguacgugaaguacgacggcgaucccugggccgacagcgacgcgcuggcccucuccggggucauggugagcauggaggagccgggcugguacuccuucggguuugagauccgcgacaagaagugcgacgugcccugcaucggcaucgagaugguccacgauggcgggaaggagaccuggcacagcgccgccaccgccaucuacugccugaugggcuccgggcagcugcucugggacacggugaccggcguggacauggcgcuguga

SEQ ID NO: 29275 - RNA, 1401 nt, Artificial Sequence
  derived and/or modified CDS sequence (AUadapt) from InfluenzaB__AGX16581__NA
augcugcccaguaccauccagacccucacgcuguuccugaccuccggcggggugcuccugagccuguacgucuccgccagccucuccuaccugcuguacagugacauccuccugaaguucuccccgaccgagaucaucgcccccaccaugccccuggacugcgcgaacgccagcaaugugcaggccgugaaccgcuccgccacgaagggcgucacccuccugcugcccgagccggaguggaccuacccccggcucagcugccccggguccaccuuccagaaggcccugcugaucagcccccaucgcuucggcgagacgaaggggaacuccgcgccgcucaucauccgggagcccuucaucgccugcggccccaaggagugcaagcacuuugcccugacccacuacgccgcgcagcccggcggguacuacaacggcacccgcggggaccggaauaagcugcgccaccucaucucggugaagcugggcaagaucccgaccguggagaacuccaucuuccacauggccgccuggagcggguccgccugccaugacggcaaggaguggacguacaucggcgucgacgggcccgacaacaacgcccugcucaagaucaaguauggcgaggcguacaccgacaccuaccacagcuacgccaauaacauccugcggacccaggaguccgccugcaacugcaucgggggcaacugcuaucugaugaucacggacggcagcgccucggggaucuccgagugccgcuuccucaagauccgggagggccgcaucaucaaggagaucuuccccaccgggcgggugaagcauaccgaggagugcacgugcggcuucgccagcaacaagaccaucgagugcgcgugucgcgacaacuccuacaccgccaagcggcccuucgugaagcugaacgucgagaccgacaccgccgagauccgccugaugugcacggagaccuaucucgacaccccgcggcccgacgacgggagcaucaccggccccugcgaguccaacggcgauaaggggagcggcgggaucaagggcggguucgugcaccagcgcauggccuccaagaucggccggugguacucgcgcacgauguccaagaccaagcggaugggcauggggcuguacgugaaguaugacggcgaccccugggccgacagcgacgcgcuggcccucuccggggucauggugagcauggaggagccgggcugguauuccuucggguucgagaucaaggacaagaagugcgacgugcccugcaucggcaucgagaugguccaugacggcgggaaggagaccuggcacagcgccgccaccgccaucuacugccugaugggcuccgggcagcugcucugggacacggugaccggcguggacauggcgcuguga

SEQ ID NO: 29276 - RNA, 1401 nt, Artificial Sequence; identical to SEQ ID NO: 29275
  derived and/or modified CDS sequence (AUadapt) from InfluenzaB__AGX16592__NA

SEQ ID NO: 29277 - RNA, 1401 nt, Artificial Sequence; identical to SEQ ID NO: 28729
  derived and/or modified CDS sequence (AUadapt) from InfluenzaB__AGX16603__NA

SEQ ID NO: 29278 - RNA, 1401 nt, Artificial Sequence; identical to SEQ ID NO: 28795
  derived and/or modified CDS sequence (AUadapt) from InfluenzaB__AGX16614__NA

SEQ ID NO: 29279 - RNA, 1401 nt, Artificial Sequence; identical to SEQ ID NO: 29273
  derived and/or modified CDS sequence (AUadapt) from InfluenzaB__AGX16625__NA

SEQ ID NO: 29280 - RNA, 1401 nt, Artificial Sequence
  derived and/or modified CDS sequence (AUadapt) from InfluenzaB__AGX16636__NA
augcugcccaguaccauccagacccucacgcuguuccugaccuccggcggggugcuccugagccuguacgucuccgccagccucuccuaccugcuguacagugacauccuccugaaguucuccccgaccgagaucaucgcccccaccaugccccuggacugcgcgaacgccagcaacgugcaggccgugaaucgcuccgccacgaagggcgucacccuccugcugcccgagccggaguggaccuacccccggcucagcugccccggguccaccuuccagaaggcccugcugaucucgccccaccgcuuuggcgagacgaaggggaacuccgcgccgcucaucauccgggagcccuucaucgccugcggccccaaggagugcaagcacuucgcccugacccacuaugccgcgcagcccggcggguacuacaacggcacccgcggggaccggaacaagcugcgccaccucaucagcgugaagcugggcaagaucccgaccguggagaauuccaucuuccacauggccgccuggagcggguccgccugccacgacggcaaggaguggacguauaucggcgucgacgggcccgacaacaacgcccugcucaagaucaaguacggcgaggcguacaccgacaccuaucacucguacgccaacaacauccugcggacccaggaguccgccugcaacuguaucgggggcaacugcuaccugaugaucacggacggcagcgccagcgggaucuccgagugucgcuuccucaagauccgggagggccgcaucaucaaggagaucuuccccaccgggcgggugaagcacaccgaggagugcacgugcggcuucgccucgaauaagaccaucgagugcgcgugccgcgacaacuccuacaccgccaagcggcccuucgugaagcugaaugucgagaccgacaccgccgagauccgccugaugugcacggagaccuaccucgacaccccgcggcccgacgacgggagcaucaccggccccugugaguccaacggcgacaaggggagcggcgggaucaagggcggguucgugcaccagcgcauggccuccaagaucggccggugguacucgcgcacgauguccaagaccaagcggaugggcauggggcuguaugugaaguacgacggcgaccccugggccgacagcgacgcgcuggcccucuccggggucauggugaguauggaggagccgggcugguacuccuucggguucgagaucaaggacaagaagugcgacgugcccugcaucggcaucgagaugguccaugacggcgggaaggagaccuggcacagcgccgccaccgccaucuacugccugaugggcuccgggcagcugcucuggaacacggugaccggcguggacauggcgcuguga

SEQ ID NO: 29281 - RNA, 1401 nt, Artificial Sequence; identical to SEQ ID NO: 28727
  derived and/or modified CDS sequence (AUadapt) from InfluenzaB__AGX16647__NA

SEQ ID NO: 29282 - RNA, 1401 nt, Artificial Sequence; identical to SEQ ID NO: 29275
  derived and/or modified CDS sequence (AUadapt) from InfluenzaB__AGX16658__NA

SEQ ID NO: 29283 - RNA, 1401 nt, Artificial Sequence; identical to SEQ ID NO: 28729
  derived and/or modified CDS sequence (AUadapt) from InfluenzaB__AGX16669__NA

SEQ ID NO: 29284 - RNA, 1401 nt, Artificial Sequence; identical to SEQ ID NO: 28795
  derived and/or modified CDS sequence (AUadapt) from InfluenzaB__AGX16680__NA

SEQ ID NO: 29285 - RNA, 1401 nt, Artificial Sequence; identical to SEQ ID NO: 28729
  derived and/or modified CDS sequence (AUadapt) from InfluenzaB__AGX16691__NA

SEQ ID NO: 29286 - RNA, 1401 nt, Artificial Sequence
  derived and/or modified CDS sequence (AUadapt) from InfluenzaB__AGX16702__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccgcuccgccaccaagggcgucacccuccugcugcccgagccggaguggaccuacccccggcucagcugccccggguccacguuccagaaggcccugcugaucucgccccaucgcuucggcgagaccaaggggaacuccgcgccgcucaucauccgggagcccuucaucgccugcggccccaaggagugcaagcacuuugcccugacccacuacgccgcgcagcccggcggguacuacaacggcaagcgcggggaccggaauaagcugcgccaccucaucagcgugaagcugggcaagaucccgaccguggagaacuccaucuuccacauggccgccuggagcggguccgccugccaugacggcaaggaguggacguacaucggcgucgacgggcccgacaacaacgcccugcucaagaucaaguauggcgaggcguacaccgacaccuaccacucguacgccaauaacauccugcggacccaggaguccgccugcaacugcaucgggggcaacugcuaucugaugaucacggacggcagcgccagcgggaucuccgagugccgcuuccucaagauccgggagggccgcaucaucaaggagaucuuccccaccgggcgggugaagcauaccgaggagugcacgugcggcuucgccucgaacaagaccaucgagugcgcgugucgcgacaacuccuacaccgccaagcggcccuucgugaagcugaacgucgagaccgacaccgccgagauccgccugaugugcacggagaccuaucucgacaccccgcggcccgacgacgggagcaucaccggccccugcgaguccaacggcgauaaggggagcggcgggaucaagggcggguucgugcaccagcgcauggccuccaagaucggccggugguacucgcgcacgauguccaagaccaagcggaugggcauggggcuguacgugaaguaugacggcgaccccugggccgacagcgacgcgcuggcccucuccggggucauggugagcauggaggagccgggcugguauuccuucggguucgagaucaaggacaagaagugcgacgugcccugcaucggcaucgagaugguccaugacggcgggaaggagaccuggcacagcgccgccaccgccaucuacugccugaugggcuccgggcagcugcucugggacacggugaccggcguggacauggcgcuguga

SEQ ID NO: 29287 - RNA, 1401 nt, Artificial Sequence
  derived and/or modified CDS sequence (AUadapt) from InfluenzaB__AGX16713__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccagcaacgugcaggccgugaaccgcuccgccaccaagggcgucacccuccugcugcccgagccggaguggaccuacccccggcucagcugccccggguccaucuuucagaaggcccugcugaucucgccccaccgcuucggcgagacgaaggggaacuccgcgccgcucaucauccgggagcccuucaucgccuguggccccaaggagugcaagcacuucgcccugacccacuacgccgcgcagcccggcggguacuauaacggcacccgcggggaccggaacaagcugcgccaccucaucagcgugaagcugggcaagaucccgaccguggagaauuccaucuuccacauggccgccuggagcggguccgccugccacgauggcaaggaguggacguacaucggcgucgacgggcccgacaacaacgcccugcucaagaucaaguacggcgaggcguauaccgacaccuaccacagcuacgccaauaacauccugcggacccaggaguccgccugcaacugcaucgggggcaacugcuaucugaugaucacggacggcagcgccagcgggaucuccgagugccgcuuccucaagauccgggagggccgcaucaucaaggagaucuuucccaccgggcgggugaagcacaccgaggagugcacgugcggcuucgccucgaacaagaccaucgagugugcgugccgcgacaacuccuacaccgccaagcggcccuucgugaagcugaaugucgagaccgacaccgccgagauccgccugaugugcacggagaccuaccucgacaccccgcggcccgacgaugggagcaucaccggccccugcgaguccaacggcgacaaggggagcggcgggaucaagggcggguucgugcaucagcgcauggccuccaagaucggccggugguacagccgcacgauguccaagaccaagcggaugggcauggggcuguacgugaaguacgacggcgaucccugggccgacagcgacgcgcuggcccucuccggggucauggugagcauggaggagccgggcugguacuccuucggguuugagauccgcgacaagaagugcgacgugcccugcaucggcaucgagaugguccacgauggcgggaaggagaccuggcacagcgccgccaccgccaucuacugccugaugggcuccgggcagcugcucugggacacggugaccggcguggacauggcgcuguga

SEQ ID NO: 29288 - RNA, 1401 nt, Artificial Sequence; identical to SEQ ID NO: 28729
  derived and/or modified CDS sequence (AUadapt) from InfluenzaB__AGX16724__NA

SEQ ID NO: 29289 - RNA, 1401 nt, Artificial Sequence; identical to SEQ ID NO: 29275
  derived and/or modified CDS sequence (AUadapt) from InfluenzaB__AGX16735__NA

SEQ ID NO: 29290 - RNA, 1401 nt, Artificial Sequence; identical to SEQ ID NO: 29275
  derived and/or modified CDS sequence (AUadapt) from InfluenzaB__AGX16746__NA

SEQ ID NO: 29291 - RNA, 1401 nt, Artificial Sequence; identical to SEQ ID NO: 28729
  derived and/or modified CDS sequence (AUadapt) from InfluenzaB__AGX16757__NA

SEQ ID NO: 29292 - RNA, 1401 nt, Artificial Sequence
  derived and/or modified CDS sequence (AUadapt) from InfluenzaB__AGX16768__NA
augcugcccaguaccauccagacccucacgcuguuccugaccuccggcggggugcuccugagccuguacgucuccgccagccucuccuaccugcuguacagugacauccuccugaaguucuccccgaccgagaucaucgcccccaccaugccccuggacugcgcgaacgccagcaacgugcaggccgugaaucgcuccgccacgaagggcgucacccuccugcugcccgagccggaguggaccuacccccggcucagcugccccggguccaccuuccagaaggcccugcugaucucgccccaccgcuuuggcgagacgaaggggaacuccgcgccgcucaucauccgggagcccuucaucgccugcggccccaaggagugcaagcacuucgcccugacccacuaugccgcgcagcccggcggguacuacaacggcacccgcggggaccggaacaagcugcgccaccucaucagcgugaagcugggcaagaucccgaccguggagaauuccaucuuccacauggccgccuggagcggguccgccugccacgacggcaaggaguggacguauaucggcgucgacgggcccgacaacaacgcccugcucaagaucaaguacggcgaggcguacaccgacaccuaucacucguacgccaacaacauccugcggacccaggaguccgccugcaacuguaucgggggcaacugcuaccugaugaucacggacggcagcgccagcgggaucuccgagugucgcuuccucaagauccgggagggccgcaucaucaaggagaucuuccccaccgggcgggugaagcacaccgaggagugcacgugcggcuucgccucgaauaagaccaucgagugcgcgugccgcgacaacuccuacaccgccaagcggcccuucgugaagcugaaugucgagaccgacaccgccgagauccgccugaugugcacggagaccuaccucgacaccccgcggcccgacgacgggagcaucaccggccccuguaaguccaacggcgacaaggggagcggcgggaucaagggcggguucgugcaccagcgcauggccuccaagaucggccggugguacucgcgcacgauguccaagaccaagcggaugggcauggggcuguaugugaaguacgacggcgaccccugggccgacagcgacgcgcuggcccucuccggggucauggugaguauggaggagccgggcugguacuccuucggguucgagaucaaggacaagaagugcgacgugcccugcaucggcaucgagaugguccaugacggcgggaaggagaccuggcacagcgccgccaccgccaucuacugccugaugggcuccgggcagcugcucugggacacggugaccggcguggacauggcgcuguga

SEQ ID NO: 29293 - RNA, 1401 nt, Artificial Sequence; identical to SEQ ID NO: 28795
  derived and/or modified CDS sequence (AUadapt) from InfluenzaB__AGX16779__NA

SEQ ID NO: 29294 - RNA, 1401 nt, Artificial Sequence
  derived and/or modified CDS sequence (AUadapt) from InfluenzaB__AGX16790__NA
augcugcccaguaccauccagacccucacgcuguuccugaccuccggcggggugcuccugagccuguacgucuccgccagccucuccuaucugcuguacagcgacauccuccugaaguucuccccgaccgagaucaccgcccccacgaugccccuggacugugcgaacgccagcaacgugcaggccgugaaccgcuccgccaccaagggcgucacccuccugcugcccgagccggaguggaccuacccccggcucaguugccccggguccacguuccagaaggcccugcugaucagcccccaccgcuucggcgagaccaaggggaauuccgcgccgcucaucauccgggagcccuucaucgccugcggccccaaggagugcaagcacuuugcccugacccacuacgccgcgcagcccggcggguacuacaacggcacccgcgggggccggaauaagcugcgccaccucaucagcgugaagcuggggaagaucccgacgguggagaacuccaucuuccacauggccgccuggaguggcuccgccugccacgacggcaaggaguggaccuacaucggggucgacggccccgauaacaacgcccugcucaagaucaaguacggggaggcguacaccgauaccuaccacucguacgccaacaauauccugcggacgcaggaguccgccugcaacugcaucggcggcaacugcuaucugaugaucaccgacgggagcgccagcggcaucuccgagugccgcuuccucaagauccgggaggggcgcaucaucaaggagaucuuucccaccggccgggugaagcacaccgaggagugcacgugcggguucgccaguaacaagaccaucgagugcgcgugccgcgacaacuccuauaccgccaagcggcccuucgugaagcugaacgucgagaccgacacggccgagauccgccugaugugcaccgagaccuaccucgauaccccgcggcccgacgacggcagcaucacgggccccugcgaguccaacggggauaagggcagcgggggcaucaagggcggguucgugcaccagcgcauggccuccaagaucggccggugguacagucgcaccauguccaagaccaagcggauggggaugggccuguacgugaaguacgacggggaccccugggccgacagugacgcgcuggcccucuccggcgucauggugagcauggaggagccggggugguacuccuucggcuucgagauccgcgauaagaagugcgacgugcccugcaucggcaucgagaugguccacgacgggggcaaggagaccuggcauagcgccgccacggccaucuacugccugaugggguccggccagcugcucugggacaccgugaccggcguggacauggcgcuguga

SEQ ID NO: 29295 - RNA, 1401 nt, Artificial Sequence
  derived and/or modified CDS sequence (AUadapt) from InfluenzaB__AGX16801__NA
augcugcccaguaccauccagacccucacgcuguuccugaccuccggcggggugcuccugagccuguacgucuccgccagccucuccuaccugcuguacagugacauccuccugaaguucuccccgaccgagaucaucgcccccaccaugccccuggacugcgcgaacgccagcaacgugcaggccgugaaucgcuccgccacgaagggcgucacccuccugcugcccgagccggaguggaccuacccccggcucagcugccccggguccaccuuccagaaggcccugcugaucucgccccaccgcuuuggcgagacgaaggggaacuccgcgccgcucaucauccgggagcccuucaucgccugcggccccaaggagugcaagcacuucgcccugacccacuaugccgcgcagcccggcggguacuacaacggcacccgcggggaccggaacaagcugcgccaccucaucagcgugaagcugggcaagaucccgaccguggagaauuccaucuuccacauggccgccuggagcggguccgccugccacgacggcaaggaguggacguauaucggcgucgacgggcccgacaacaacgcccugcucaagaucaaguacggcgaggcguacaccgacaccuaucacucguacgccaacaacauccugcggacccaggaguccgccugcaacuguaucgggggcaacugcuaccugaugaucacggacggcagcgccagcgggaucuccgagugucgcuuccucaagauccgggagggccgcaucaucaaggagaucuuccccaccgggcgggugaagcacaccgaggagugcacgugcggcuucgccucgaauaagaccaucgagugcgcgugccgcgacaacuccuacaccgccaagcggcccuucgugaagcugaaugucgagaccgacaccgccgagauccgccugaugugcacggagaccuaccucgacaccccgcggcccaacgacgggagcaucaccggccccugugaguccaacggcgacaaggggagcggcgggaucaagggcggguucgugcaccagcgcauggccuccaagaucggccggugguacucgcgcacgauguccaagaccaagcggaugggcauggggcuguaugugaaguacgacggcgaccccugggccgacagcgacgcgcuggcccucuccggggucauggugaguauggaggagccgggcugguacuccuucggguucgagaucaaggacaagaagugcgacgugcccugcaucggcaucgagaugguccaugacggcgggaaggagaccuggcacagcgccgccaccgccaucuacugccugaugggcuccgggcagcugcucugggacacggugaccggcguggacauggcgcuguga

SEQ ID NO: 29296 - RNA, 1401 nt, Artificial Sequence; identical to SEQ ID NO: 28729
  derived and/or modified CDS sequence (AUadapt) from InfluenzaB__AGX16812__NA

SEQ ID NO: 29297 - RNA, 1401 nt, Artificial Sequence
  derived and/or modified CDS sequence (AUadapt) from InfluenzaB__AGX16823__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccucgaacgugcaggccgugaaccgcuccgccaccaagggcgucacccuccugcugcccgagccggaguggaccuacccccggcucagcugccccggguccacguuucagaaggcccugcugaucagcccccaccgcuucggcgagaccaaggggaacuccgcgccgcucaucauccgggagcccuucaucgccuguggccccaaggagugcaagcacuucgcccugacccacuacgccgcgcagcccggcggguauuacaacggcacccgcggggaccggaacaagcugcgccaccucaucagcgugaagcugggcaagaucccgacgguggagaauuccaucuuccacauggccgccuggagcggguccgccugccacgauggcaaggaguggaccuacaucggcgucgacgggcccgacaacaacgcccugcucaagaucaaguauggcgaggcguacaccgacaccuaccacucguacgccaauaacauccugcggacgcaggaguccgccugcaacugcaucgggggcaacuguuaccugaugaucaccgacggcagcgccagcgggaucuccgagugccgcuuccucaagauccgggagggccgcaucaucaaggagaucuuucccaccgggcgggugaagcacaccgaggagugcacgugcggcuucgccagcaauaagaccaucgagugcgcgugccgcgacaacuccuacaccgccaagcggcccuuugugaagcugaacgucgagaccgacacggccgagauccgccugaugugcaccgagaccuaccucgacaccccgcggcccgccgacgggaguaucacgggccccugcgaguccaacggcgacaaggggucgggcgggaucaagggcggguucgugcaucagcgcauggccuccaagaucggccggugguacagccgcaccauguccaagaccaagcggaugggcauggggcuguacgugaaguacgacggcgaucccugggcggacagcgacgcccuggcccucuccggggucauggugagcauggaggagccgggcugguacuccuucggguuugagaucaaggacaagaagugcgacgugcccugcaucggcaucgagaugguccacgauggcgggaaggagaccuggcacagcgccgccacggcgaucuacugccugaugggcuccgggcagcugcucugggacaccgugaccggcguggacauggcccuguga

SEQ ID NO: 29298 - RNA, 1401 nt, Artificial Sequence; identical to SEQ ID NO: 28729
  derived and/or modified CDS sequence (AUadapt) from InfluenzaB__AGX16834__NA

SEQ ID NO: 29299 - RNA, 1401 nt, Artificial Sequence
  derived and/or modified CDS sequence (AUadapt) from InfluenzaB__AGX16845__NA
augcugcccaguaccauccagacccucacgcuguuccugaccuccggcggggugcuccugagccuguacgucuccgccagccucuccuaccugcuguauucggacauccuccugaaguucuccccgaccgagaucaccacgcccaccaugccccuggacugcgccaacgcgaguaacgugcaggccgugaaccgcuccgccaccaagggcgucacccuccugcugcccgagccggaguggacguacccccggcucagcugccccggguccaccuuccagaaggcccugcuggugaguccccaccgcuucggcgagaccaaggggaacuccgccccgcucaucauccgggagcccuucaucgcgugcggccccaaggagugcaagcauuucgcccugacccacuacgccgcccagcccggcggguacuacaauggcacgcgcggggaccggaacaagcugcgccaccucaucucggugaagcugggcaagaucccgaccgucgagaacuccaucuuccauauggcggccuggagcggguccgccugccacgacggcaaggaguggaccuacaucggcguggacgggcccgauaacaacgcccugcucaagaucaaguacggcgaggccuacaccgacacguaccauagcuacgcgaacaacauccugcggacccaggaguccgccugcaacuguaucgggggcaacugcuaccugaugaucaccgacggcagcgccagugggaucuccgagugccgcuuccucaagauccgggagggccgcaucaucaaggagaucuuccccaccgggcgggugaagcacacggaggagugcacgugcggcuuugccagcaacaagaccaucgagugcgccugccgcgacaacuccuauaccgcgaagcggcccuucgucaagcugaacguggagaccgacaccgccgagauccgccugaugugcaccgagaccuaccucgacacgccgcggcccgaugacgggagcaucaccggccccugcgaguccaacggcgacaaggggaguggcgggaucaagggcggguucgugcaccagcgcauggccuccaagaucggccggugguacucgcgcaccauguccaagaccaagcggaugggcauggggcuguacgucaaguacgauggcgaccccugggccgacagcgacgcccuggcgcucuccggggugauggugagcauggaggagccgggcugguacuccuuuggguucgagaucaaggacaagaagugcgacguccccugcaucggcaucgagauggugcacgauggcgggaaggagacguggcacagcgccgccaccgccaucuacugccugaugggcuccgggcagcugcucugggacaccgugaccggcgucgacauggcccuguga

SEQ ID NO: 29300 - RNA, 1401 nt, Artificial Sequence
  derived and/or modified CDS sequence (AUadapt) from InfluenzaB__AGX16856__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacggugccccuggacugcgcgaaugccagcaacgugcaggccgucaaccgcuccgccaccaagggcgugacccuccugcugcccgagccggaguggaccuacccccggcucucgugccccggguccacguuucagaaggcccugcugaucagcccccaccgcuucggcgagaccaaggggaacuccgcgccgcucaucauccgggagcccuucaucgccuguggccccaaggagugcaagcacuucgcccugacccacuacgccgcgcagcccggcggguacuauagcggcacccgcggggaccggaacaagcugcgccaccucaucuccgugaagcugggcaagaucccgacggucgagaacaguaucuuccacauggccgccugguccgggagcgccugccacgacggcaaggaguggaccuauaucggcguggacgggcccgacaacaacgcccugcucaagaucaaguacggcgaggcguauaccgacaccuaccacuccuacgccaacaacauccugcggacgcaggagagugccugcaacugcaucgggggcaacugcuaucugaugaucaccgacggcagcgccuccgggaucagcgagugccgcuuccucaagauccgggagggccgcaucaucaaggagaucuuccccaccgggcgggugaagcauaccgaggagugcacgugcggcuucgccuccaacaagaccaucgagugcgcgugucgcgacaacagcuacaccgccaagcggcccuucgucaagcugaacguggagaccgauacggccgagauccgccugaugugcaccgagaccuaccucgacaccccgcggcccgacgacggguccaucacgggccccugugagagcaacggcgacaagggguccggcgggaucaagggcggguucgugcaccagcgcauggccucgaagaucggccggugguauucccgcaccaugagcaagaacaagcggaugggcauggggcuguacgucaaguacgacggcgaucccugggccgacuccgacgcgcuggcccucagcggggugaugguguccauggaggagccgggcugguacagcuucggguuugagaucaaggacaagaagugcgacguccccugcaucggcaucgagauggugcacgauggcgggaaggagaccuggcacuccgccgccaccgccaucuacugccugaugggcagcgggcagcugcucugggacacggugaccggcgucgacauggcgcuguga

SEQ ID NO: 29301 - RNA, 1401 nt, Artificial Sequence; identical to SEQ ID NO: 28729
  derived and/or modified CDS sequence (AUadapt) from InfluenzaB__AGX16867__NA

SEQ ID NO: 29302 - RNA, 1401 nt, Artificial Sequence
  derived and/or modified CDS sequence (AUadapt) from InfluenzaB__AGX16878__NA
augcugcccaguaccauccagacccucacgcuguuccugaccuccggcggggugcuccugagccuguacgucuccgccagccucuccuaccugcuguauucggacauccuccugaaguucuccccgaccgagcugaccgcccccacgaugccccucgacugcgcgaacgccaguaacgugcaggccgugaaccgcuccgccaccaagggcgucacccugcugcuccccgagccggaguggaccuacccccggcugagcugccccggguccacguuccagaaggcccugcucaucaguccccaccgcuucggcgagaccaaggggaacuccgcgccgcugaucauccgggagcccuucaucgccugcggccccaaggagugcaagcauuucgcccugacccacuacgccgcgcagcccggcggguacuacaacggcaagcgcggggaucggaacaagcuccgccaccugaucucggugaagcugggcaagaucccgaccguggagaacuccaucuuccacauggccgccuggaguggguccgccugccacgacggcaaggaguggacguacaucggcgucgacgggcccgauaacaacgcccuccugaagaucaaguacggcgaggcguacaccgacaccuaccauagcuacgccaacaacauccugcggacccaggaguccgccugcaacuguaucgggggcaacugcuaccucaugaucacggacggcagcgccucggggaucuccgagugucgcuuccugaagauccgggagggccgcaucaucaaggagaucuuccccaccgggcgggugaagcacaccgaggagugcacgugcggcuucgccaguaacaagaccaucgagugcgcgugccgcgacaacuccuacaccgccaagcggcccuuugugaagcugaacgucgagaccgacaccgccgagauccgccucaugugcacggagaccuaccuggacaccccgcggcccgaugacgggagcaucaccggccccugcgaguccaacggcgacaacgggaguggcgggaucaagggcggguucgugcaccagcgcauggccuccaagaucggccggugguacucgcgcacgauguccaagaccaagcggaugggcauggggcuguacgugaaguacgauggcgaccccugggccgacagcgacgcgcucgcccuguccggggucauggugagcauggaggagccgggcugguacuccuuuggguucgagaucaaggacaagaagugcgacgugcccugcaucggcaucgagaugguccacgauggcgggaaggagaccuggcacagcgccgccaccgccaucuacugccugaugggcuccgggcagcuccugugggacacggugaccggcguggacauggcgcuguga

SEQ ID NO: 29303 - RNA, 1401 nt, Artificial Sequence; identical to SEQ ID NO: 29275
  derived and/or modified CDS sequence (AUadapt) from InfluenzaB__AGX16889__NA

SEQ ID NO: 29304 - RNA, 1401 nt, Artificial Sequence
  derived and/or modified CDS sequence (AUadapt) from InfluenzaB__AGX16900__NA
augcugcccaguaccauccagacccucacgcuguuccugaccaccggcggggugcuccugucccuguacgucagcgccucccucagcuaccugcuguacuccgauauccuccugaaguucucgccgaccgagaucaucgcccccacgaugccccuggacugcgcgaacgccuccaacgugcaggccgugaaucgcagcgccaccaagggcgucacccuccugcugcccgagccggaguggaccuacccccggcucuccugccccgggagcacguuccagaaggcccugcugaucucgccccaucgcuucggcgagaccaaggggaacuccgcgccgcucaucauccgggagcccuucaucgccugcggccccaaggagugcaagcacuuugcccugacccacuacgccgcgcagcccggcggguacuacaacggcacccgcggggaccggaauaagcugcgccaccucaucuccgugaagcugggcaagaucccgacgguggagaacagcaucuuccacauggccgccugguccgggagcgccugccaugacggcaaggaguggaccuacaucggcgucgacgggcccgacaacaacgcccugcucaagaucaaguauggcgaggcguacaccgacaccuaccacuccuacgccaacaauauccugcggacgcaggagucggccugcaacugcaucgggggcaacugcuaucugaugaucaccgacggcuccgccagcgggaucagcgagugccgcuuccucaagauccgggagggccgcaucaucaaggagaucuuccccaccgggcgggugaagcauaccgaggagugcacgugcggcuucgccuccaacaagaccaucgagugcgcgugccgcgauaacucguacaccgccaagcggcccuucgugaagcugaacgucgagaccgacacggccgagauccgccugaugugcaccgagaccuaucucgacaccccgcggcccgacgacggguccaucacgggccccugcgagagcaacggcgauaagggguccggcgggaucaagggcggguucgugcaccagcgcauggccagcaagaucggccggugguacucccgcaccaugucgaagaccaagcggaugggcauggggcuguacgugaaguaugacggcgaccccugggccgacuccgacgcgcuggcccucagcggggucaugguguccauggaggagccgggcugguacaguuucggguucgagaucaaggacaagaagugcgacgugcccugcaucggcaucgagaugguccaugacggcgggaaggagaccuggcacuccgccgccacggccaucuacugccugaugggcagcgggcagcugcucugggacaccgugaccggcguggacauggcgcuguga

SEQ ID NO: 29305 - RNA, 1401 nt, Artificial Sequence
  derived and/or modified CDS sequence (AUadapt) from InfluenzaB__AGX16911__NA
augcugcccaguaccauccagacccucacgcuguuccugaccuccggcggggugcuccugagccuguacgucuccgcccuccugagcuaccugcucuauuccgacauccugcugaaguucucgccgaccgagaucaccgcccccacgaugccccucgacugcgcgaacgccuccaaugugcaggccgugaaccgcagcgccaccaagggcgucacccugcugcuccccgagccggaguggaccuacccccggcuguccugccccgggagcacguuccagaaggcccugcucaucaguccccaccgcuucggcgagaccaaggggaacuccgcgccgcugaucauccgggagcccuucaucgccugcggccccaaggagugcaagcauuucgcccugacccacuacgccgcgcagcccggcggguacuacaauggcacccgcggggaccggaacaagcuccgccaccugaucuccgugaagcugggcaagaucccgacgguggagaacucgaucuuccauauggccgccugguccgggagcgccugccacgacggcaaggaguggaccuacaucggcgucgacgggcccgauaacaacgcccuccugaagaucaaguacggcgaggcguacaccgacaccuaccauuccuacgccaacaacauccugcggacgcaggagagcgccugcaacuguaucgggggcaacugcuaccucaugaucaccgacggcuccgccagcgggaucagugagugccgcuuccugaagauccgggagggccgcaucaucaaggagaucuuccccaccgggcgggugaagcacaccgaggagugcacgugcggcuuugccuccaacaagaccaucgagugcgcgugccgcgacaacagcuauaccgccaagcggcccuucgugaagcugaacgucgagaccgacacggccgagauccgccucaugugcaccgagaccuaccuggacaccccgcggcccgaugacggguccaucacgggccccugcgagagcaacggcgacaagggguccggcgggaucaagggcggguuugugcaccagcgcauggccagcaagaucggccggugguacucccgcaccaugucgaagaccaagcggaugggcauggggcuguacgugaaguacgauggcgaccccugggccgacuccgacgcgcucgcccugagcggggucaugguguccauggaggagccgggcugguacagcuuuggguucgagaucaaggacaagaagugcgacgugcccugcaucggcaucgagaugguccacgauggcgggaaggagaccuggcacuccgccgccacggccaucuacugccugaugggcagcgggcagcuccugugggacaccgugaccggcguggacauggcgcuguga

SEQ ID NO: 29306 - RNA, 1401 nt, Artificial Sequence
  derived and/or modified CDS sequence (AUadapt) from InfluenzaB__AGX16922__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccgcuccgccaccaagggcgucaccuuccuccugcccgagccggaguggaccuacccccggcugagcugccccggguccacguuccagaaggcccuccugaucaguccccaccgcuucggcgagaccaaggggaacuccgcgccgcugaucauccgggagcccuucaucgccugcggccccaaggagugcaagcauuucgcccucacccacuacgccgcgcagcccggcggguacuacaacggcacccgcggggaccggaauaagcugcgccaccugaucucggugaagcucggcaagaucccgacgguggagaacuccaucuuccacauggccgccuggagcggguccgccugucacgacggcaaggaguggaccuacaucggcgucgacgggcccgacaacaaugcccugcugaagaucaaguacggcgaggcguacaccgacaccuaccacagcuaugccaacaacauccuccggacgcaggaguccgccugcaacugcaucgggggcaacugcuaucugaugaucaccgacggcagcgccucggggaucuccgagugccgcuuccugaagauccgggagggccgcaucaucaaggagaucuuccccaccgggcgggugaagcauaccgaggagugcacgugcggcuucgccagcaacaagaccaucgagugcgcgugucgcgacaacuccuacaccgccaagcggcccuucgugaagcucaacgucgagaccgacacggccgagauccgccugauguguaccgagaccuaccuggacaccccgcggcccgacgacgggagcaucacgggccccugcgaguccaacggcgauaaggggagcggcgggaucaagggcggguucgugcaccagcgcauggccuccaagaucggccggugguacucgcgcaccauguccaagaccaagcggaugggcauggggcucuacgugaaguaugacggcgaccccugggccgacagcgacgcgcuggcccuguccggggucauggugagcauggaggagccgggcugguauuccuucggguucgagaucaaggacaagaagugcgacgugcccugcaucggcaucgagaugguccaugacggcgggaaggagaccuggcacagcgccgccacggccaucuacugccucaugggcuccgggcagcugcugugggacaccgugaccggcguggacauggcgcucuga

SEQ ID NO: 29307 - RNA, 1401 nt, Artificial Sequence
  derived and/or modified CDS sequence (AUadapt) from InfluenzaB__AGX16933__NA
augcugcccaguaccauccagacccucacgcuguuccugaccuccggcggggugcuccugagccuguacgucuccgccagccucuccuaccugcuguacagugacauccuccugaaguucuccccgaccgagaucaacgcccccaccaugccccuggacugcgcgaacgccaguaacgugcaggccgugaaccgcuccgccacgaagggcgucacccuccugcugcccgagccggaguggaccuacccccggcucagcugccccggguccaccuuccagaaggcccugcugaucaguccccaccgcuucggcgagacgaaggggaacuccgcgccgcucaucauccgggagcccuucaucgccugcggccccaaggagugcaagcauuucgcccugacccacuacgccgcgcagcccggcggguacuacaacggcacccgcggggaccggaauaagcugcgccaccucaucagcgugaagcugggcaagaucccgaccguggagaacuccaucuuccacauggccgccuggagcggguccgccugucacgacggcaaggaguggacguacaucggcgucgacgggcccgacaacaaugcccugcucaagaucaaguacggcgaggcguacaccgacaccuaccacucguaugccaacaacauccugcggacccaggaguccgccugcaacugcaucgggggcaacugcuaucugaugaucacggacggcagcgccagcgggaucuccgagugccgcuuccucaagauccgggagggccgcaucaucaaggagaucuuccccaccgggcgggugaagcauaccgaggagugcacgugcggcuucgccucgaacaagaccaucgagugcgcgugucgcgacaacuccuacaccgccaagcggcccuucgugaagcugaacgucgagaccgacaccgccgagauccgccugauguguacggagaccuaccucgacaccccgcggcccgacgacgggagcaucaccggccccugcgaguccaacggcgauaaggggagcggcgggaucaagggcggguucgugcaccagcgcauggccuccaagaucggccggugguacucgcgcacgauguccaagaccaagcggaugggcauggggcuguacgugaaguaugacggcgaccccugggccgacagcgacgcgcuggcccucuccggggucauggugagcauggaggagccgggcugguauuccuucggguucgagaucaaggacaagaagugcgacgugcccugcaucggcaucgagaugguccaugacggcgggaaggagaccuggcacagcgccgccaccgccaucuacugccugaugggcuccgggcagcugcuccuggacacggugaccggcguggacauggcgcuguga

SEQ ID NO: 29308 - RNA, 1401 nt, Artificial Sequence
  derived and/or modified CDS sequence (AUadapt) from InfluenzaB__AGX16944__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaaggagugcaagcauuucgcccugacccacuacgccgcgcagcccggcggguacuacagcggcacccgcggggaucggaacaagcugcgccaccucaucuccgugaagcugggcaagaucccgacgguggagaacucgaucuuccacauggccgccugguccgggagugccugccacgacggcaaggaguggaccuacaucggcgucgacgggcccgauaacaacgcccugcucaagaucaaguacggcgaggcguacaccgacaccuaccauuccuacgccaacaacauccugcggacgcaggagagcgccugcaacuguaucgggggcaacugcuaccugaugaucaccgacggcagcgccuccgggaucucggagugucgcuuccucaagauccgggagggccgcaucaucaaggagaucuuccccaccgggcgggugaagcacaccgaggagugcacgugcggcuucgccuccaauaagaccaucgagugcgcgugccgcgacaacagcuacaccgccaagcggcccuuugugaagcugaacgucgagaccgacacggccgagauccgccugaugugcaccgagaccuaccucgacaccccgcggcccgaugacggguccaucacgggccccugcgagagcaacggcgacaagggguccggcgggaucaagggcggguucgugcaucagcgcauggccagcaagaucggccggugguacucccgcaccaugucgaagaacaagcggaugggcauggggcuguacgugaaguacgauggcgaccccugggccgacuccgacgcgcuggcccucagcggggucaugguguccauggaggagccgggcugguacagcuuuggguucgagaucaaggacaagaagugcgacgugcccugcaucggcaucgagaugguccacgauggcgggaaggagaccuggcacuccgccgccaccgccaucuacugccugaugggcagcgggcagcugcucugggacacggugaccggcguggacauggcgcuguga

SEQ ID NO: 29309 - RNA, 1401 nt, Artificial Sequence; identical to SEQ ID NO: 28729
  derived and/or modified CDS sequence (AUadapt) from InfluenzaB__AGX16955__NA

SEQ ID NO: 29310 - RNA, 1401 nt, Artificial Sequence; identical to SEQ ID NO: 28727
  derived and/or modified CDS sequence (AUadapt) from InfluenzaB__AGX16966__NA

SEQ ID NO: 29311 - RNA, 1401 nt, Artificial Sequence; identical to SEQ ID NO: 28729
  derived and/or modified CDS sequence (AUadapt) from InfluenzaB__AGX16977__NA

SEQ ID NO: 29312 - RNA, 1401 nt, Artificial Sequence; identical to SEQ ID NO: 28729
  derived and/or modified CDS sequence (AUadapt) from InfluenzaB__AGX16988__NA

SEQ ID NO: 29313 - RNA, 1401 nt, Artificial Sequence; identical to SEQ ID NO: 29273
  derived and/or modified CDS sequence (AUadapt) from InfluenzaB__AGX16999__NA

SEQ ID NO: 29314 - RNA, 1401 nt, Artificial Sequence; identical to SEQ ID NO: 28729
  derived and/or modified CDS sequence (AUadapt) from InfluenzaB__AGX17010__NA

SEQ ID NO: 29315 - RNA, 1401 nt, Artificial Sequence; identical to SEQ ID NO: 29275
  derived and/or modified CDS sequence (AUadapt) from InfluenzaB__AGX17021__NA

SEQ ID NO: 29316 - RNA, 1401 nt, Artificial Sequence
  derived and/or modified CDS sequence (AUadapt) from InfluenzaB__AGX17032__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccucggacgugcaggccgugaaccgcuccgccaccaagggcgucacccuccugcugcccgagccggaguggaccuacccccggcucagcugccccggguccacguuucagaaggcccugcugaucagcccccaccgcuucggcgagaccaaggggaacuccgcgccgcucaucauccgggagcccuucaucgccuguggccccaaggagugcaagcacuucgcccugacccacuacgccgcgcagcccggcggguacuauaaccgcacccggggcgaccgcaacaagcugcggcaccucaucagcgugaagcuggggaagaucccgacgguggagaauuccaucuuccacauggccgccuggagcggcuccgccugccacgaugggaaggaguggaccuacaucggcgucgacggccccgacaacaacgcccugcucaagaucaaguacggggaggcguauaccgacaccuaccacucguacgccaauaacauccugcgcacgcaggaguccgccugcaacugcaucggcgggaacugcuaucugaugaucaccgacggcagcgccagcggcaucuccgagugccgguuccucaagauccgcgaggggcggaucaucaaggagaucuuucccaccggccgcgugaagcacaccgaggagugcacgugcggguucgccagcaacaagaccaucgagugugcgugccgggacaacuccuacaccgccaagcgccccuucgugaagcugaaugucgagaccgacacggccgagauccggcugaugugcaccgagaccuaccucgacaccccgcgccccgacgauggcagcaucacggggcccugcgaguccaacggcgacaagggcucggggggcaucaagggcggguucgugcaucagcggauggccuccaagaucgggcgcugguacagccggaccauguccaagaccaagcgcaugggcaugggccuguacgugaaguacgacggggaucccugggccgacagcgacgcgcuggcccucuccggcgucauggugagcauggaggagccggggugguacuccuucggcuuugagaucaaggacaagaagugcgacgugcccugcaucgggaucgagaugguccacgauggcggcaaggagaccuggcacagcgccgccacggccaucuacugccugaugggguccggccagcugcucugggacaccgugaccgggguggacauggcgcuguga

SEQ ID NO: 29317 - RNA, 1401 nt, Artificial Sequence; identical to SEQ ID NO: 28727
  derived and/or modified CDS sequence (AUadapt) from InfluenzaB__AGX17043__NA

SEQ ID NO: 29318 - RNA, 1401 nt, Artificial Sequence
  derived and/or modified CDS sequence (AUadapt) from InfluenzaB__AGX17054__NA
augcugcccaguaccauccagacccucacgcuguuccugaccuccggcggggugcuccugagccuguacgucuccgccucgcucuccuaccugcuguacagugacauccuccugaaguucuccccgaccgagaucaccgcccccacgaugccccuggacugcgcgaacgccagcaaugugcaggccgugaaccgcuccgccaccaagggcgucacccuccugcugcccgagccggaguggaccuacccccggcucucgugccccggguccacguuccagaaggcccugcugaucagcccccaucgcuucggcgagaccaaggggaacuccgcgccgcucaucauccgggagcccuucaucgccugcggccccaaggagugcaagcacuucgcccugacccauuacgccgcgcagcccggcggguacuacaacggcacccgcggggaccggaacaagcugcgccaucucaucagcgugaagcugggcaagaucccgacgguggagaacuccaucuuccacauggccgccuggucgggguccgccugccaugacggcaaggaguggaccuacaucggcgucgacgggcccgacaacaacgcccugcucaagaucaaguacggcgaggcguauaccgacaccuaccacagcuacgccaacaauauccugcggacgcaggaguccgccugcaacugcaucgggggcaacugcuaccugaugaucaccgauggcucggccagcgggaucuccgagugccgcuuccucaagauccgggagggccgcaucaucaaggagaucuuccccaccgggcgggugaagcacaccgaggaguguacgugcggcuucgccagcaacaagaccaucgagugcgcgugccgcgacaauuccuacaccgccaagcggcccuucgugaagcugaacgucgagaccgacacggccgagauccgccugaugugcaccgagaccuaccucgauaccccgcggcccgacgacgggucgaucacgggccccugcgaguccaacggcgacaaugggaacggcgggaucaagggcggguucgugcaccagcgcauggccagcaagaucggccggugguacucccgcaccaugagcaagaccaagcggaugggcauggggcuguacgugaaguaugacggcgaccccugggccgacuccgacgcgcuggcccucucgggggucaugguguccauggaggagccgggcugguacaguuucggguucgagaucaaggacaagaagugcgacgugcccugcaucggcaucgagaugguccaugacggcgggaaggagaccuggcacuccgccgccacggccaucuacugccugaugggcagcgggcagcugcucugggacaccgugaccggcguggacauggcgcuguga

SEQ ID NO: 29319 - RNA, 1401 nt, Artificial Sequence
  derived and/or modified CDS sequence (AUadapt) from InfluenzaB__AGX17065__NA
augcugcccaguaccauccagacccucacgcuguuccugaccuccggcggggugcuccugagccuguacgucuccgcccuccugucguaccugcucuacuccgacauccugcugaaguucagcccgaccaagaucaucgcccccaccacgucccucgauucggcgaacgccuccaacuuccaggccgugaaccacagcgccaccaaggagaugaccuuccugcugcccgagcccgaguggaccuacccgcgccucuccugucagggcucgacguuccagaaggcccugcugaucagcccccaccgguucggggaggcgaagggcaacuccgcgccccucaucauccgcgagcccuucaucgccugcgggccgaaggagugcaagcacuuugcccugacccacuacgccgcccagcccggcggcuacuacaacgggacccgggaggaccgcaacaagcugcggcaccucaucuccgugaaccugggcaagauccccaccgucgagaauucgaucuuccacauggccgccugguccgggagcgccugccacgacggccgcgaguggacguacaucgggguggacggccccgacuccaaugcgcugaucaagaucaaguacggcgaggccuacaccgacaccuaccacagcuacgccaacaacauccuccggacccaggagagugccugcaacugcaucgggggcgacugcuaccugaugaucacggacggguccgccagcggcaucuccaagugccgcuuucugaagauccgggagggccgcaucaucaaggagaucuucccgaccgggcggguggagcacaccgaggagugcacgugcggcuucgcgucgaacaagaccaucgagugcgccugccgcgacaauuccuacaccgccaagcggcccuucgucaagcucaacguggagaccgacaccgccgagauccgccugaugugcacggagaccuaccuggacacgccccggcccgacgacgggaguaucaccggcccgugcgaguccaacggggacaagggcucgggcgggaucaagggcggguucgugcaccagcgcauggccuccaagaucggccggugguacagccgcaccaucuccaagaccaagcggauggggauggagcucuacgucaaguacgauggcgaccccuggaccgacucggacgcgcuggcccccuccggcgugauggugagcaucgaggagcccgggugguacuccuucggcuucgagaucaaggacaagaagugugacgucccgugcaucgggaucgagauggugcacgacggcgggaagaccacguggcacagcgccgccaccgccaucuacugccugaugggcuccggccagcuccugugggacaccgugaccggggucgacauggcgcuguga

SEQ ID NO: 29320 - RNA, 1401 nt, Artificial Sequence
  derived and/or modified CDS sequence (AUadapt) from InfluenzaB__AGX17076__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccagcaacgugcaggccgugaaccgcuccgccaccaagggcgucacccuccugcugcccgagccggaguggaccuacccccggcucagcugucccggguccacguuccagaaggcccugcugaucucgccccaccgcuucggcgagaccaaggggaacuccgcgccgcucaucauccgggagcccuuuaucgccugcggccccaaggagugcaagcacuucgcccugacccacuaugccgcgcagcccggcggguacuacaacggcacccgcggggaccggaacaagcugcgccaucucaucagcgugaagcugggcaagaucccgacgguggagaacuccaucuuccacauggccgccuggagcggguccgccugucacgacggcaaggaguggaccuacaucggcgucgacgggcccgacaauaacgcccugcucaagaucaaguacggcgaggcguacaccgacaccuaccauagcuacgccaacaacauccugcggacgcaggaguccgccugcaacuguaucgggggcaacugcuaccugaugaucaccgacggcagcgccagugggaucuccgagugccgcuuccucaagauccgggagggccgcaucaucaaggagaucuuccccaccgggcgggugaagcacaccgaggagugcacguguggcuucgccucgaacaagaccaucgagugcgcgugccgcgauaacuccuacaccgccaagcggcccuucgugaagcugaacgucgagaccgacacggccgagauccgccugauguguaccgagaccuaccucgacaccccgcggcccgacgacgggagcaucacgggccccugugaguccaacggcgacaaggggagcggcgggaucaagggcggguucgugcaccagcgcauggccuccaagaucggccggugguauagccgcaccauguccaagaccaagcggaugggcauggggcuguacgugaaguacgacggcgaccccugggccgauagcgacgcgcuggcccucuccggggucauggugagcauggaggagccgggcugguacuccuucggguuugagauccgcgacaagaagugcgacgugcccugcaucggcaucgagaucguccacgauggcgggaaggagaccuggcacagcgccgccacggccaucuacugccugaugggcuccgggcagcugcucugggacaccgugaccggcguggacauggcgcuguga

SEQ ID NO: 29321 - RNA, 1401 nt, Artificial Sequence; identical to SEQ ID NO: 29275
  derived and/or modified CDS sequence (AUadapt) from InfluenzaB__AGX17087__NA

SEQ ID NO: 29322 - RNA, 1401 nt, Artificial Sequence; identical to SEQ ID NO: 29275
  derived and/or modified CDS sequence (AUadapt) from InfluenzaB__AGX17098__NA

SEQ ID NO: 29323 - RNA, 1401 nt, Artificial Sequence; identical to SEQ ID NO: 29275
  derived and/or modified CDS sequence (AUadapt) from InfluenzaB__AGX17109__NA

SEQ ID NO: 29324 - RNA, 1401 nt, Artificial Sequence; identical to SEQ ID NO: 29275
  derived and/or modified CDS sequence (AUadapt) from InfluenzaB__AGX17120__NA

SEQ ID NO: 29325 - RNA, 1401 nt, Artificial Sequence; identical to SEQ ID NO: 28727
  derived and/or modified CDS sequence (AUadapt) from InfluenzaB__AGX17131__NA

SEQ ID NO: 29326 - RNA, 1401 nt, Artificial Sequence; identical to SEQ ID NO: 28729
  derived and/or modified CDS sequence (AUadapt) from InfluenzaB__AGX17142__NA

SEQ ID NO: 29327 - RNA, 1401 nt, Artificial Sequence
  derived and/or modified CDS sequence (AUadapt) from InfluenzaB__AGX17153__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccgcuccgccaccaagggcgucacccuccugcugcccgagccggaguggaccuacccccggcucagcugccccggguccacguuccagaaggcccugcugaucagcccccaucgcuucggcgagaccaaggggaacuccgcgccgcucaucauccgggagcccuucaucgccugcggccccaaggagugcaagcacuuugcccugacccacuacgccgcgcagcccggcggguacuacaacggcacccgcggggaccggaauaagcugcgccaccucaucucggugaagcugggcaagaucccgacgguggagaacuccaucuuccacauggccgccuggagcggguccgccugccaugacggcaaggaguggaccuacaucggcgucgacgggcccgacaacaacgcccugcucaagaucaaguauggcgaggcguacaccgacaccuaccacagcuacgccaauaacauccugcggacgcaggaguccgccugcaacugcaucgggggcaacugcuaucugaugaucaccgacggcagcgccucggggaucuccgagugccgcuuccucaagauccgggagggccgcaucaucaaggagaucuuccccaccgggcgggugaagcauaccgaggagugcacgugcggcuucgccagcaacaagaccaucgagugcgcgugucgcgacaacuccuacaccgccaagcggcccuucgugaagcugaacgucgagaccgacacggccgagauccgccugaugugcaccgagaccuaucucgacaccccgcggcccgacgacgggagcaucaucggccccugcgaguccaacggcgauaaggggagcggcgggaucaagggcggguucgugcaccagcgcauggccuccaagaucggccggugguacucgcgcacgauguccaagaccaagcggaugggcauggggcuguacgugaaguaugacggcgaccccugggccgacagcgacgcgcuggcccucuccggggucauggugagcauggaggagccgggcugguauuccuucggguucgagaucaaggacaagaagugcgacgugcccugcaucggcaucgagaugguccaugacggcgggaaggagaccuggcacagcgccgccaccgccaucuacugccugaugggcuccgggcagcugcucugggacacggugaccggcguggacauggcgcuguga

SEQ ID NO: 29328 - RNA, 1401 nt, Artificial Sequence; identical to SEQ ID NO: 29275
  derived and/or modified CDS sequence (AUadapt) from InfluenzaB__AGX17164__NA

SEQ ID NO: 29329 - RNA, 1404 nt, Artificial Sequence
  derived and/or modified CDS sequence (AUadapt) from InfluenzaB__AGX17175__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccagcaacgugcaggccgugaaccgcuccgccaccaagggcgucacccuccugcugcuccccgagccggaguggaccuacccccggcugagcugccccggguccacguuucagaaggcccugcucaucucgccccaccgcuucggcgagaccaaggggaacuccgcgccgcugaucauccgggagcccuucaucgccuguggccccaaggagugcaagcacuucgcccugacccacuacgccgcgcagcccggcggguacuauaacggcacccgcggggaccggaacaagcuccgccaccugaucagcgugaagcugggcaagaucccgacgguggagaauuccaucuuccacauggccgccuggagcggguccgccugccacgauggcaaggaguggaccuacaucggcgucgacgggcccgacaacaacgcccuccugaagaucaaguacggcgaggcguauaccgacaccuaccacagcuacgccaauaacauccugcggacgcaggaguccgccugcaacugcaucgggggcaacugcuaucucaugaucaccgacggcagcgccagcgggaucuccgagugccgcuuccugaagauccgggagggccgcaucaucaaggagaucuuucccaccgggcgggugaagcacaccgaggagugcacgugcggcuucgccucgaacaagaccaucgagugugcgugccgcgacaacuccuacaccgccaagcggcccuucgugaagcugaaugucgagaccgacacggccgagauccgccucaugugcaccgagaccuaccuggacaccccgcggcccgacgaugggagcaucacgggccccugcgaguccaacggcgacaaggggagcggcgggaucaagggcggguucgugcaucagcgcauggccuccaagaucggccggugguacagccgcaccauguccaagaccaagcggaugggcauggggcuguacgugaaguacgacggcgaucccugggccgacagcgacgcgcucgcccuguccggggucauggugagcauggaggagccgggcugguacuccuucggguuugagauccgcgacaagaagugcgacgugcccugcaucggcaucgagaugguccacgauggcgggaaggagaccuggcacagcgccgccacggccaucuacugccugaugggcuccgggcagcuccugugggacaccgugaccggcguggacauggcgcuguga

SEQ ID NO: 29330 - RNA, 1401 nt, Artificial Sequence
  derived and/or modified CDS sequence (AUadapt) from InfluenzaB__AGX17186__NA
augcugcccaguaccauccagacccucacgcuguuccugaccuccggcggggugcuccugagccuguacgucuccgccagccucuccuaccugcuguauagcgacauccuccugaaguucuccccgaccgagaucaccacgcccaccaugccccuggacugcgccaacgcgaguaacgugcaggccgugaaccgcuccgccaccaagggcgucacccuccugcugcccgagccggaguggacguacccccggcucagcugccccggguccaccuuccagaaggcccugcugaucaguccccaccgcuucggcgagaccaaggggaacuccgccccgcucaucauccgggagcccuucaucgcgugcggccccaaggagugcaagcauuucgcccugacccacuacgccgcccagcccggcggguacuacaauggcacgcgcggggaccggaacaagcugcgccaccucaucagcgugaagcugggcaagaucccgaccguggagaacuccaucuuccauauggcggccuggagcggguccgccugccacgacggcaaggaguggaccuacaucggcgucgacgggcccgauaacaacgcccugcucaagaucaaguacggcgaggccuacaccgacacguaccauucguacgcgaacaacauccugcggacccaggaguccgccugcaacuguaucgggggcaacugcuaccugaugaucaccgacggcagcgccagugggaucuccgagugccgcuuccucaagauccgggagggccgcaucaucaaggagaucuuccccaccgggcgggugaaguacacggaggagugcacgugcggcuuugccagcaacaagaccaucgagugcgccugccgcgacaacuccuauaccgcgaagcggcccuucgugaagcugaacgucgagaccgacaccgccgagauccgccugaugugcaccgagaccuaccucgacacgccgcggcccgaugacgggagcaucaccggccccugcgaguccaacggcgacaaggggaguggcgggaucaagggcggguucgugcaccagcgcauggccuccaagaucggccggugguacagccgcaccauguccaagacccggcgcaugggcauggggcuguacgugaaguacgauggcgaccccugggccgacagcgacgcccuggcgcucuccggggucauggugagcauggaggagccgggcugguacuccuuuggguucgagaucaaggacaagaagugcgacgugcccugcaucggcaucgagaugguccacgauggcgggaaggagacguggcacagcgccgccaccgccaucuacugccugaugggcuccgggcagcugcucugggacaccgugaccggcguggacauggcccuguga

SEQ ID NO: 29331 - RNA, 1401 nt, Artificial Sequence; identical to SEQ ID NO: 29306
  derived and/or modified CDS sequence (AUadapt) from InfluenzaB__AGX17197__NA

SEQ ID NO: 29332 - RNA, 1401 nt, Artificial Sequence
  derived and/or modified CDS sequence (AUadapt) from InfluenzaB__AGX17208__NA
augcugcccaguaccauccagacccucacgcuguuccugaccuccggcggggugcuccugagccuguacgucuccgccagccucuccuaccugcuguauagcgacauccuccugaaguucuccccgaccgagaucaccacgcccaccaugccccuggacugcgccaaugcgucgaacgugcaggccgugaaccgcuccgccaccaagggcgucacccuccugcugcccgagccggaguggacguacccccggcucagcugccccggguccaccuuucagaaggcccugcugaucagcccccaccgcuucggcgagaccaaggggaacuccgccccgcucaucauccgggagcccuucaucgcguguggccccaaggagugcaagcacuucgcccugacccacuacgccgcccagcccggcggguacuauaacggcacgcgcggggaccggaacaagcugcgccaccucaucagcgugaagcugggcaagaucccgaccguggagaauuccaucuuccacauggcggccuggagcggguccgccugccacgauggcaaggaguggaccuacaucggcgucgacgggcccgacaacaacgcccugcucaagaucaaguacggcgaggccuauaccgacacguaccacucguacgcgaauaacauccugcggacccaggaguccgccugcaacugcaucgggggcaacugcuaucugaugaucaccgacggcagcgccagcgggaucuccgagugccgcuuccucaagauccgggagggccgcaucaucaaggagaucuuucccaccgggcgggugaagcacacggaggagugcacgugcggcuucgccagcaacaagaccaucgagugugccugccgcgacaacuccuacaccgcgaagcggcccuucgugaagcugaaugucgagaccgacaccgccgagauccgccugaugugcaccgagaccuaccucgacacgccgcggcccgacgaugggagcaucaccggccccugcgaguccaacggcgacaaggggucgggcgggaucaagggcggguucgugcaucagcgcauggccuccaagaucggccggugguacagccgcaccauguccaagacccggcgcaugggcauggggcuguacgugaaguacgacggcgaucccugggccgacagcgacgcccuggcgcucuccggggucauggugagcauggaggagccgggcugguacuccuucggguuugagaucaaggacaagaagugcgacgugcccugcaucggcaucgagaugguccacgauggcgggaaggagacguggcacagcgccgccaccgccaucuacugccugaugggcuccgggcagcugcucugggacaccgugaccggcguggacauggcccuguga

SEQ ID NO: 29333 - RNA, 1401 nt, Artificial Sequence; identical to SEQ ID NO: 29275
  derived and/or modified CDS sequence (AUadapt) from InfluenzaB__AGX17219__NA

SEQ ID NO: 29334 - RNA, 1401 nt, Artificial Sequence; identical to SEQ ID NO: 28729
  derived and/or modified CDS sequence (AUadapt) from InfluenzaB__AGX17230__NA

SEQ ID NO: 29335 - RNA, 1401 nt, Artificial Sequence; identical to SEQ ID NO: 29275
  derived and/or modified CDS sequence (AUadapt) from InfluenzaB__AGX17241__NA

SEQ ID NO: 29336 - RNA, 1401 nt, Artificial Sequence
  derived and/or modified CDS sequence (AUadapt) from InfluenzaB__AGX17252__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccucgaaugugcaggccgugaaccgcuccgccaccaagggcgucacccuccugcugcccgagcucgaguggaccuacccgcggcugagcugccccggguccacguuccagaaggcccugcucaucagcccccaucgcuucggcgagaccaaggggaacuccgcgccccugaucauccgggagccguucaucgccugcggccccaaggagugcaagcacuuugcccugaccuacuacgccgcgcagcccggcggguacuacaacggcacccgcggggaccggaauaagcuccgccaccugaucagcgugaagcugggcaagauccccacgguggagaacuccaucuuccacauggccgccuggagcggguccgccugucacgacggcaaggaguggaccuacaucggcgucgacgggccggacaacaaugcccuccugaagaucaaguacggcgaggcguacaccgacaccuaccacucguaugccaacaacauccugcggacgcaggaguccgccugcaacugcaucgggggcaacugcuaucucaugaucaccgacggcagcgccagcgggaucuccgagugccgcuuccugaagauccgggagggccgcaucaucaaggagaucuuccccaccgggcgggugaagcauaccgaggagugcacgugcggcuucgccagcaacaagaccaucgagugcgcgugucgcgacaacuccuacaccgccaagcggcccuucgugaagcugaacgucgagaccgacacggccgagauccgccucauguguaccgagaccuaccuggacacgccccggccggccgacgggagcaucaccggccccugcgaguccaacggcgauaaggggucgggcgggaucaagggcggguucgugcaccagcgcauggccuccaagaucggccggugguacagccgcaccauguccaagaccaagcggaugggcauggggcuguacgugaaguaugacggcgaccccugggcggacagcgacgcccucgcccuguccggggucauggugagcauggaggagcccggcugguauuccuucggguucgagaucaaggacaagaagugcgacgugccgugcaucggcaucgagaugguccaugacggcgggaaggagaccuggcacagcgccgccacggcgaucuacugccugaugggcuccgggcagcuccugugggacaccgugaccggcguggacauggcccuguga

SEQ ID NO: 29337 - RNA, 1401 nt, Artificial Sequence
  derived and/or modified CDS sequence (AUadapt) from InfluenzaB__AGX17263__NA
augcugcccaguaccauccagacccucacgcuguuccugaccuccggcggggugcuccugagccuguacgucuccgccagccucuccuaccugcuguauucggacauccuccugaagcuguccccgaccgagaucaccgcccccacgaugccccucgacugcgcgaacgccaguaacgugcaggccgugaaccgcuccgccaccaagggcgucacccugcugcuccccgagccggaguggaccuacccccggcugagcugccccggguccacguuccagaaggcccugcucaucaguccccaccgcuucggcgagaccaaggggaacuccgcgccgcugaucauccgggagcccuucaucgccugcggccccaaggaguguaagcacuucgcccugacccacuacgccgcgcagcccggcggguacuauaacggcacccgcggggaccggaacaagcuccgccaccugaucucggugaagcugggcaagaucccgacgguggagaacuccaucuuucacauggccgccuggagcggguccgccugccacgacggcaaggaguggaccuauaucggcgucgacgggcccgacaacaacgcccuccugaagaucaaguacggcgaggcguauaccgacaccuaccacagcuacgccaacaauauccugcggacgcaggaguccgccugcaacugcaucgggggcaacugcuaucucaugaucaccgacggcagcgccucggggaucuccgagugccgcuuccugaagauccgggagggccgcaucaucaaggagaucuuccccaccgggcgggugaagcauaccgaggagugcacgugcggcuucgccagcaacaagaccaucgagugugcgugccgcgacaacuccuacaccgccaagcggcccuucgugaagcugaaugucgagaccgacacggccgagauccgccucaugugcaccgagaccuaccuggacaccccgcggcccgacgacgggaguaucacgggccccugcgaguccaacggcgacaaggggagcggcgggaucaagggcggguucgugcaucagcgcauggccuccaagaucggccggugguacucgcgcaccauguccaagaccaagcggaugggcauggggcuguacgugaaguacgacggcgaucccugggccgacagcgacgcgcucgcccuguccggggucauggugagcauggaggagccgggcugguacuccuucggguuugagaucaaggacaagaagugcgacgugcccugcaucggcaucgagaugguccacgauggcgggaaggagaccuggcacagcgccgccacggccaucuacugccugaugggcuccgggcagcuccugugggacaccgugaccggcguggacauggcgcuguga

SEQ ID NO: 29338 - RNA, 1401 nt, Artificial Sequence
  derived and/or modified CDS sequence (AUadapt) from InfluenzaB__AGX17274__NA
augcugcccaguaccauccagacccucacgcuguuccugaccuccggcggggugcuccugagccuguacgucuccgccagccucuccuaccugcuguacagugacauccuccugaaguucuccccgaccgagaucaacgcccccaccaugccccuggacugcgcgaacgccaguaacgugcaggccgugaaccgcuccgccacgaagggcgucacccuccugcugcccgagccggaguggaccuacccccggcucagcugccccggguccaccuuccagaaggcccugcugaucaguccccaccgcuucggcgagacgaaggggaacuccgcgccgcucaucauccgggagcccuucaucgccugcggccccaaggagugcaagcauuucgcccugacccacuacgccgcgcagcccggcggguacuacaacggcacccgcggggaccggaauaagcugcgccaccucaucagcgugaagcugggcaagaucccgaccguggagaacuccaucuuccacauggccgccuggagcggguccgccugucacgacggcaaggaguggacguacaucggcgucgacgggcccgacaacaaugcccugcucaagaucaaguacggcgaggcguacaccgacaccuaccacucguaugccaacaacauccugcggacccaggaguccgccugcaacugcaucgggggcaacugcuaucugaugaucacggacggcagcgccagcgggaucuccgagugccgcuuccucaagauccgggagggccgcaucaucaaggagaucuuccccaccgggcgggugaagcauaccgaggagugcacgugcggcuucgccucgaacaagaccaucgagugcgcgugucgcgacaacuccuacaccgccaagcggcccuucgugaagcugaacgucgagaccgacaccgccgagauccgccugauguguacggagaccuaccucgacaccccgcggcccgacgacgggagcaucaccggccccugcgaguccaacggcgauaaggggagcggcgggaucaagggcggguucgugcaccagcgcauggccuccaagaucggccggugguacucgcgcacgauguccaagaccaagcggaugggcauggggcuguacgugaaguaugacggcgaccccugggccgacagcgacgcgcuggcccucuccggggucauggugagcauggaggagccgggcugguauuccuucggguucgagaucaaggacaagaagugcgacgugcccugcaucggcaucgagaugguccaugacggcgggaaggagaccuggcacagcgccgccaccgccaucuacugccugaugggcuccgggcagcugcucugggacacggugaccggcguggacauggcgcuguga

SEQ ID NO: 29339 - RNA, 1401 nt, Artificial Sequence
  derived and/or modified CDS sequence (AUadapt) from InfluenzaB__AGX17285__NA
augcugcccaguaccauccagacccucacgcuguuccugaccuccggcggggugcuccugagccuguacauguccgccagccucuccuaccugcuguacagugacauccuccugaaguucuccccgaccgagaucaccgcccccacgaugccccuggacugcgcgaacgccagcaauguccaggccgugaaccgcuccgccaccaagggcgugacccuccugcugcccgagccggaguggaccuacccccggcucagcugccccggguccacguuccagaaggcccugcugaucucgccccaucgcuucggcgagaccaaggggaacuccgcgccgcucaucauccgggagcccuucaucgccugcggccccaaggagugcaagcacuuugcccugacccacuacgccgcgcagcccggcggguacuacaacggcacccgcggggaccggaauaagcugcgccaccucaucagcgucaagcugggcaagaucccgacgguggagaacuccaucuuccacauggccgccuggagcggguccgccugccaugacggcaaggaguggaccuacaucggcguggacgggcccgacaacaacgcccugcucaagaucaaguauggcgaggcguacaccgacaccuaccacucguacgccaauaacauccugcggacgcaggaguccgccugcaacugcaucgggggcaacugcuaucugaugaucaccgacggcagcgccagcgggaucuccgagugccgcuuccucaagauccgggagggccgcaucaucaaggagaucuuccccaccgggcgggucaagcauaccgaggagugcacgugcggcuucgccucgaacaagaccaucgagugcgcgugucgcgacaacuccuacaccgccaagcggcccuucgugaagcugaacguggagaccgacacggccgagauccgccugaugugcaccgagaccuaucucgacaccccgcggcccgacgacgggagcaucacgggccccugcgaguccaacggcgauaaggggagcggcgggaucaagggcggguucguccaccagcgcauggccuccaagaucggccggugguacucgcgcaccauguccaagaccaagcggaugggcauggggcuguacgugaaguaugacggcgaccccugggccgacagcgacgcgcuggcccucuccggggugauggucagcauggaggagccgggcugguauuccuucggguucgagaucaaggacaagaagugcgacgugcccugcaucggcaucgagauggugcaugacggcgggaaggagaccuggcacagcgccgccacggccaucuacugccugaugggcuccgggcagcugcucugggacaccgucaccggcguggacauggcgcuguga

SEQ ID NO: 29340 - RNA, 1401 nt, Artificial Sequence
  derived and/or modified CDS sequence (AUadapt) from InfluenzaB__AGX17296__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccucgaacgugcaggccgugaaccgcuccgccaccaagggcgucacccuccugcugcccgagccggaguggaccuacccccggcucagcugccccggguccacguuucagaaggcccugcugaucagcccccaccgcuucggcgaggcgaaggggaacuccgccccgcucaucauccgggagcccuucaucgccuguggccccaaggagugcaagcacuucgcccugacccacuacgcggcccagcccggcggguacuauaacggcacccgcggggaccggaacaagcugcgccaccucaucagcgugaagcugggcaagaucccgaccguggagaauuccaucuuccacauggccgccuggagcggguccgccugccacgauggcaaggaguggacguacaucggcgucgacgggcccgacaacaacgcgcugcucaagaucaaguacggcgaggccuauaccgacaccuaccacucguacgccaauaacauccugcggacccaggaguccgccugcaacugcaucgggggcaacugcuaucugaugaucacggacggcagcgccagcgggaucuccgagugccgcuuccucaagauccgggagggccgcaucaucaaggagaucuuucccaccgggcgggugaagcacaccgaggagugcacgugcggcuucgcgagcaacaagaccaucgagugugccugccgcgacaacuccuacaccgccaagcggcccuucgugaagcugaaugucgagaccgacaccgccgagauccgccugaugugcacggagaccuaccucgacaccccgcggcccgacgaugggagcaucaccggccccugcgaguccaacggcgacaaggggucgggcgggaucaagggcggguucgugcaucagcgcauggccuccaagaucggccggugguacagccgcacgauguccaagaccaagcggaugggcauggggcuguacgugaaguacgacggcgaucccugggcggacagcgacgcccuggcccucuccggggucauggugagcauggaggagccgggcugguacuccuucggguuugagaucaaggacaagaagugcgacgugcccugcaucggcaucgagaugguccacgauggcgggaaggagaccuggcacagcgccgccaccgcgaucuacugccugaugggcuccgggcagcugcucugggacacggugaccggcguggacauggcccuguga

SEQ ID NO: 29341 - RNA, 1401 nt, Artificial Sequence; identical to SEQ ID NO: 29273
  derived and/or modified CDS sequence (AUadapt) from InfluenzaB__AGX17307__NA

SEQ ID NO: 29342 - RNA, 1401 nt, Artificial Sequence; identical to SEQ ID NO: 28727
  derived and/or modified CDS sequence (AUadapt) from InfluenzaB__AGX17318__NA

SEQ ID NO: 29343 - RNA, 1401 nt, Artificial Sequence
  derived and/or modified CDS sequence (AUadapt) from InfluenzaB__AGX17329__NA
augcugcccaguaccauccagacccucacgcuguuccugaccuccggcggggugcuccugagccuguacgucuccgccagccucuccuaccugcuguauagcgacaugcuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaaggagugcaagcauuucgcccugacccacuacgccgcgcagcccggcggguacuacagcggcacccgcggggaucggaacaagcugcgccaccucaucuccgugaagcugggcaagaucccgacgguggagaacucgaucuuccacauggccgccugguccgggagugccugccacgacggcaaggaguggaccuacaucggcgucgacgggcccgauaacaacgcccugcucaagaucaaguacggcgaggcguacaccgacaccuaccauuccuacgccaacaacauccugcggacgcaggagagcgccugcaacuguaucgggggcaacugcuaccugaugaucaccgacggcagcgccuccgggaucucggagugucgcuuccucaagauccgggagggccgcaucaucaaggagaucuuccccaccgggcgggugaagcacaccgaggagugcacgugcggcuucgccuccaauaagaccaucgagugcgcgugccgcgacaacagcuacaccgccaagcggcccuuugugaagcugaacgucgagaccgacacggccgagauccgccugaugugcaccgagaccuaccucgacaccccgcggcccgaugacggguccaucacgggccccugcgagagcaacggcgacaagggguccggcgggaucaagggcggguucgugcaucagcgcauggccagcaagaucggccggugguacucccgcaccaugucgaagaacaagcggaugggcauggggcuguacgugaaguacgauggcgaccccugggccgacuccgacgcgcuggcccucagcggggucaugguguccauggaggagccgggcugguacagcuuuggguucgagaucaaggacaagaagugcgacgugcccugcaucggcaucgagaugguccacgauggcgggaaggagaccuggcacuccgccgccaccgccaucuacugccugaugggcagcgggcagcugcucugggacacggugaccggcguggacauggcgcuguga

SEQ ID NO: 29344 - RNA, 1401 nt, Artificial Sequence; identical to SEQ ID NO: 29275
  derived and/or modified CDS sequence (AUadapt) from InfluenzaB__AGX17340__NA

SEQ ID NO: 29345 - RNA, 1401 nt, Artificial Sequence
  derived and/or modified CDS sequence (AUadapt) from InfluenzaB__AGX17351__NA
augcugcccaguaccauccagacccucacgcuguuccugaccuccggcggggugcuccugagccuguacgucuccgccagccucuccuaccugcuguauucggacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaaggagugcaagcauuucgcccugacccacuacgccgcgcagcccggcggguacuacaauggcacccgcggggaccggaacaagcugcgccaccucaucagcgugaagcugggcaagaucccgacgguggagaacuccaucuuccauauggccgccuggagcggguccgccugccacgacggcaaggaguggaccuacaucggcgucgacgggcccgauaacaacgcccugcucaagaucaaguacggcgaggcguacaccgacaccuaccauucguacgccaacaacauccugcggacgcaggaguccgccugcaacuguaucgggggcaacugcuaccugaugaucaccgacggcagcgccagugggaucuccgagugccgcuuccucaagauccgggagggccgcaucaucaaggagaucuuccccaccgggcgggugaagcacaccgaggagugcacgugcggcuuugccucgaacaagaccaucgagugcgcgugccgcgacaacuccuauaccgccaagcggcccuucgugaagcugaacgucgagaccgacacggccgagauccgccugaugugcaccgagaccuaccucgacaccccgcggcccgaugacgggagcaucacgggccccugcgagaccaacggcgacaagggguccggcgggaucaagggcggguuugugcaccagcgcauggccagcaagaucggccggugguacucccgcaccaugucgaagaccaagcggaugggcauggggcuguacgugaaguacgauggcgaccccugggccgacuccgacgcgcuggcccucagcggggucaugguguccauggaggagccgggcugguacagcuuuggguucgagaucaaggacaagaagugcgacgugcccugcaucggcaucgagaugguccacgauggcgggaaggagacguggcacuccgccgccaccgccaucuacugccugaugggcagcgggcagcugcucugggacaccgugaccggcguggacauggcgcuguga

SEQ ID NO: 29346 - RNA, 1401 nt, Artificial Sequence
  derived and/or modified CDS sequence (AUadapt) from InfluenzaB__AGX17362__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaucccccuggacugcgcgaacgccagcaauauccaggccgugaaccgcuccgccaccaagggcgugacccuccugcugcccgagccggaguggaccuacccccggcucagcugccccggguccacguuccagaaggcccugcugaucucgccccaucgcuucggcgagaccaaggggaacuccgcgccgcucaucauccgggagcccuucaucgccugcggccccaaggagugcaagcacuuugcccugacccacuacgccgcgcagcccggcggguacuacaacggcacccgcggggaccggaauaagcugcgccaccucaucagcgucaagcugggcaagaucccgacgguggagaacuccaucuuccacauggccgccuggagcggguccgccugccaugacggcaaggaguggaccuacaucggcguggacgggcccgacaacaacgcccugcucaagaucaaguauggcgaggcguacaccgacaccuaccacucguacgccaauaacauccugcggacgcaggaguccgccugcaacugcaucgggggcaacugcuaucugaugaucaccgacggcagcgccagcgggaucuccgagugccgcuuccucaagauccgggagggccgcaucaucaaggagaucuuccccaccgggcgggucaagcauaccgaggagugcacgugcggcuucgccucgaacaagaccaucgagugcgcgugucgcgacaacuccuacaccgccaagcggcccuucgugaagcugaacguggagaccgacacggccgagauccgccugaugugcaccgagaccuaucucgacaccccgcggcccgacgacgggagcaucacgggccccugcgaguccaacggcgauaaggggagcggcgggaucaagggcggguucguccaccagcgcauggccuccaagaucggccggugguacucgcgcaccauguccaagaccaagcggaugggcauggggcuguacgugaaguaugacggcgaccccugggccgacagcgacgcgcuggcccucuccggggugauggucagcauggaggagccgggcugguauuccuucggguucgagaucaaggacaagaagugcgacgugcccugcaucggcaucgagauggugcaugacggcgggaaggagaccuggcacagcgccgccacggccaucuacugccugaugggcuccgggcagcugcucugggacaccgucaccggcguggacauggcgcuguga

SEQ ID NO: 29347 - RNA, 1401 nt, Artificial Sequence
  derived and/or modified CDS sequence (AUadapt) from InfluenzaB__AGX17373__NA
augcugcccaguaccauccagacccucacgcuguuccugaccuccggcggggugcuccugagccuguacgucuccgccucgcucuccuaccugcuguacagugacauccuccugaaguucuccccgaccgagaucaccgcccccacgaugccccuggacugcgcgaacgccagcaaugugcaggccgugaaccgcuccgccaccaagggcgucacccuccugcugcccgagccggaguggaccuacccccggcucucgugccccggguccacguuccagaaggcccugcugaucagcccccaucgcuucggcgagaccaaggggaacuccgcgccgcucaucauccgggagcccuucaucgccugcggccccaaggagugcaagcacuuugcccugacccacuacgccgcgcagcccggcggguacuacaacggcacccgcggggaccggaacaagcugcgccaucucaucagcgugaagcugggcaagaucccgacgguggagaacuccaucuuccacauggccgccuggucgggguccgccugccaugacggcaaggaguggaccuacaucggcgucgacgggcccgacaacaacgcccugcucaagaucaaguauggcgaggcguacaccgacaccuaccacagcuacgccaauaacauccugcggacgcaggaguccgccugcaacugcaucgggggcaacugcuaccugaugaucaccgauggcucggccagcgggguguccgagugccgcuuccucaagauccgggagggccgcaucaucaaggagaucuuccccaccgggcgggugaagcacaccgaggaguguacgugcggcuucgccaacaacaagaccaucgagugcgcgugccgcgauaacagcuacaccgccaagcggcccuucgucaagcugaacguggagaccgacacggccgagauccgccugauguguaccgagaccuaccucgacaccccgcggcccgacgacggguccaucacgggccccugcgagucgaacggcgauaagggguccggcgggaucaagggcggguucgugcaccagcgcauggccagcaagaucggccggugguacucccgcaccaugagcaagaccaagcggaugggcauggggcuguacgucaaguaugacggcgaccccugggccgacuccgacgcgcuggcccucucgggggugaugguguccauggaggagccgggcugguacaguuucggguucgagaucaaggacaagaagugcgacguccccugcaucggcaucgagauggugcaugacggcgggaaggagaccuggcacuccgccgccacggccaucuacugccugaugggcagcgggcagcugcucugggacaccgugaccggcgucaacauggcgcuguga

SEQ ID NO: 29348 - RNA, 1401 nt, Artificial Sequence; identical to SEQ ID NO: 28727
  derived and/or modified CDS sequence (AUadapt) from InfluenzaB__AGX17384__NA

SEQ ID NO: 29349 - RNA, 1401 nt, Artificial Sequence; identical to SEQ ID NO: 28795
  derived and/or modified CDS sequence (AUadapt) from InfluenzaB__AGX17395__NA

SEQ ID NO: 29350 - RNA, 1401 nt, Artificial Sequence
  derived and/or modified CDS sequence (AUadapt) from InfluenzaB__AGX17404__NA
augcugcccaguaccauccagacccucacgcuguuccugaccuccggcggggugcuccugagccuguacgucuccgccucgcucuccuaccugcuguacagugacauccuccugaaguucuccccgaccgagaucaccgcccccacgaugccccuggacugcgcgaacgccagcaacgugcaggccgugaaucgcuccgccaccaagggcgucacccuccugcugcccgagccggaguggaccuacccccggcucucgugccccggguccacguuccagaaggcccugcugaucagcccccaccgcuucggcgagaccaaggggaauuccgcgccgcucaucauccgggagcccuucaucgccugcggccccaaggagugcaagcacuucgcccugacccacuaugccgcgcagcccggcggguacuacaacggcacccgcggggaccggaacaagcugcgccaccucaucagcgugaagcugggcaagaucccgacgguggagaauuccaucuuccacauggccgccuggucgggguccgccugccacgacggcaaggaguggaccuacaucggcgucgaugggagcgacaacaacgcccugcucaagaucaaguacggcgaggcguacaccgauaccuaccacuccuacgccaacaacauccugcggacgcaggagagcgccugcaauugcaucgggggcaacugcuaccugaugaucaccgacggcucggccuccgggaucagcgagugucgcuuccucaagauccgggagggccgcaucaucaaggagaucuuccccaccgggcgggugaagcacaccgaggagugcacgugcggcuucgccuccaauaagaccaucgagugcgcgugccgcgacaacagcuacaccgccaagcggcccuucgugaagcugaaugucgagaccgacacggccgagauccgccugaugugcaccgagaccuaccucgacacgccccggccggacgacggguccaucaccggccccugcgagaguaacggcgacaagggguccggcgggaucaagggcggguucgugcaccagcgcauggccagcaagaucggccggugguacucccgcaccaugaguaagaccaagcggaugggcauggggcuguacgugaaguacgacggcgaccccugggccgacuccgacgcgcuggcccucucggggaucauggucuccauggaggagcccggcugguauagcuucggguucgagaucaaggacaagaagugcgacgugccgugcaucggcaucgagauggugcaugacggcgggaaggagaccuggcacuccgccgccacggccaucuacugccugaugggcagcgggcagcugcucugggacaccgucaccggcguggacauggcgcuguga

SEQ ID NO: 29351 - RNA, 1401 nt, Artificial Sequence
  derived and/or modified CDS sequence (AUadapt) from InfluenzaB__AGX17415__NA
augcugcccaguaccauccagacccucacgcuguuccugaccuccggcggggugcuccugagccuguacgucuccgccagccucuccuaccugcuguauucggacauccuccugaaguucuccccgaccgagaucaccgcccccacgaugccccuggacugcgcgaacgccaguaacgugcaggccgugaaccgcuccgccaccaagggcgucacccuccugcugcccgagccggacuggaccuacccccggcucagcugccccggguccacguuucagaaggcccugcugaucagcccccaccgcuucggcgagaccaaggggaacuccgcgccgcucaucauccgggagcccuucaucgccugcggccccaaggaguguaagcacuucgcccugacccacuacgccgcgcagcccggcggguacuacaauggcacccgcggggaccggaacaagcugcgccaccucaucucggugaagcugggcaagaucccgacgguggagaacuccaucuuccauauggccgccuggagcggguccgccugccacgacggcaaggaguggaccuacaucggcgucgaugggcccgacaacaacgcccugcucaagaucaaguacggcgaggcguacaccgacaccuaucacagcuacgccaacaacauccugcggacgcaggaguccgccugcaauugcaucgggggcaacugcuaccugaugaucaccgacggcagcgccagugggaucuccgagugccgcuuccucaagauccgggagggccgcaucaucaaggagaucuuccccaccgggcgggugaagcacaccgaggagugcacgugcggcuuugccagcaacaagaccaucgagugcgcgugccgcgacaacuccuauaccgccaagcggcccuucgugaagcugaacgucgagaccgacacggccgagauccgccugaugugcaccgagaccuaccucgauaccccgcggcccgacgacgggagcaucacgggccccugcgaguccaacggcgacaaggggaguggcgggaucaagggcggguucgugcaccagcgcauggccuccaagaucggccggugguacucgcgcaccauguccaagaccaagcggaugggcauggggcuguacgugaaguacgauggcgaccccugggccgacagcgacgcgcuggcccucuccggggucauggugagcauggaggagccgggcugguacuccuuuggguucgagaucaaggacaagaagugcgacgugcccugcaucggcaucgagaugguccacgauggcgggaaggagaccuggcacagcgccgccacggccaucuacugccugaugggcuccgggcagcugcucugggacaccgugaccggcguggacauggcgcuguga

SEQ ID NO: 29352 - RNA, 1401 nt, Artificial Sequence
  derived and/or modified CDS sequence (AUadapt) from InfluenzaB__AGX17426__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccagcaacgugcaggccgugaaccgcuccgccaccaagggcgucaccuuccuccugcccgagccggaguggaccuacccccggcugagcugucccggguccacguuccagaaggcccuccugaucucgccccaccgcuucggcgagaccaaggggaacuccgcgccgcugaucauccgggagcccuuuaucgccugcggccccaaggagugcaagcacuucgcccucacccacuacgccgcgcagcccggcggguauuacaacggcacccgcggggaccggaacaagcugcgccaccugaucagugugaagcucggcaagaucccgacgguggagaacuccaucuuccacauggccgccuggagcggguccgccugccacgauggcaaggaguggaccuacaucggcgucgacgggcccgacaacaacgcccugcugaagaucaaguauggcgaggcguacaccgacaccuaccacagcuacgccaauaacauccuccggacgcaggaguccgccugcaacugcaucgggggcaacuguuaccugaugaucaccgacggcagcgccagcgggaucuccgagugccgcuuccugaagauccgggagggccgcaucaucaaggagaucuuucccaccgggcgggugaagcacaccgaggagugcacgugcggcuucgccucgaauaagaccaucgagugcgcgugccgcgacaacuccuacaccgccaagcggcccuucgugaagcucaaugucgagaccgacacggccgagauccgccugaugugcaccgagaccuaccuggacaccccgcggcccgacgaugggagcaucacgggccccugcgaguccaacggcgacaaggggagcggcgggaucaagggcggguucgugcaucagcgcauggccuccaagaucggccggugguacagccgcaccauguccaagaccaagcggaugggcauggggcucuacgugaaguacgacggcgaucccugggccgacagcgacgcgcuggcccuguccggggucauggugagcauggaggagccgggcugguacuccuucggguuugagauccgcgacaagaagugcgacgugcccugcaucggcaucgagaugguccacgauggcgggaaggagaccuggcacagcgccgccacggccaucuacugccucaugggcuccgggcagcugcugugggacaccgugaccggcguggacauggcgcucuga

SEQ ID NO: 29353 - RNA, 1401 nt, Artificial Sequence
  derived and/or modified CDS sequence (AUadapt) from InfluenzaB__AGX17437__NA
augcugcccaguaccauccagacccucacgcuguuccugaccuccggcggggugcuccugagccuguacgucuccgugagccucuccuaccugcuguacagugacauccuccugaaguucuccccgaccgagaucaccgcccagacgaugccccuggacuucgccaacgcgucgaaugugcaggccgucaaccgcuccgccaccaagggcgugacccuccugcugcccgagcccgaguggaccuacccgcggcucagcugccccggguccacguuccagaaggcccugcugaucagcccccaucgcuucggcgagaccaaggggaacuccgcgccccucaucauccgggagccguucaucgccugcggccccaaggagugcaagcacuuugcccugacccacuacgccgcccagcccggcggguacuacaacggcacccgcggggaccggaauaagcugcgccaccucaucagcgugaagcugggcaagauccccacggucgagaacuccaucuuccacauggcggccuggagcggguccgccugccaugacggcaaggaguggaccuacaucggcguggacgggccggacaacaacgcccugcucaagaucaaguauggcgaggccuacaccgacaccuaccacucguacgcgaauaacauccugcggacgcaggaguccgccugcaacugcaucgggggcaacugcuaucugaugaucaccgacggcagcgccagcgggaucuccgagugccgcuuccucaagauccgggagggccgcaucaucaaggagaucuuccccaccgggcgggugaagcauaccgaggagugcacgugcggcuucgccagcaacaagaccaucgagugcgccugucgcgacaacuccuacaccgcgaagcggcccuucgucaagcugaacguggagaccgacacggccgagauccgccugaugugcaccgagaccuaucucgacacgccccggccggacgacgggagcaucaccggccccugcgaguccaacggcgauaaggggucgggcgggaucaagggcggguucgugcaccagcgcauggccuccaagaucggccggugguacagccgcaccauguccaagaccaagcggaugggcauggggcuguacgucaaguaugacggcgaccccugggccgacagcgacgcccuggcgcucuccggggugauggugagcauggaggagcccggcugguauuccuucggguucgagauccgcgacaagaagugcgacgucccgugcaucggcaucgagauggugcaugacggcgggaaggagaccuggcacagcgccgccacggccaucuacugccugaugggcuccgggcagcugcucugggacaccgugaccggcgucgacauggcccuguga

SEQ ID NO: 29354 - RNA, 1401 nt, Artificial Sequence
  derived and/or modified CDS sequence (AUadapt) from InfluenzaB__AGX17448__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccgcuccgccaccaagggcgucacccuccugcugcccgagccggaguggaccuacccccggcucagcugccccggguccacguuccagaaggcccugcugaucucgccccaucgcuucggcgagaccaaggggaacuccgcgccgcucaucauccgggagcccuucaucgccugcggccccaaggagugcaagcacuuugcccugacccacuacgccgcgcagcccggcggguacuacaacggcacccgcggggaccggaauaagcugcgccaccucaucagcgugaagcugggcaagaucccgacgguggagaacuccaucuuccacauggccgccuggagcggguccgccugccaugacggcaaggaguggaccuacaucggcgucgacgggcccgacaacaacgcccugcucaagaucaaguauggcgaggcguacaccgacaccuaccacucguacgccaauaacauccugcggacgcaggaguccgccugcaacugcaucgggggcaacugcuaucugaugaucaccgacggcagcgccagcgggaucuccgagugccgcuuccucaagauccgggagggccgcaucaucaaggagaucuuccccaccgggcgggugaagcauaccgaggagugcacgugcggcuucgccucgaacaagaccaucgagugcgcgugucgcgacaacuccuacaccgccaagcggcccuucgugaagcugaacgucgagaccgacacggccgagauccgccugaugugcaccgagaccuaucucgacaccccgcggcccgacgacgggagcaucacgggccccugcgagaccaacggcgauaagggguccggcgggaucaagggcggguucgugcaccagcgcauggccagcaagaucggccggugguacucccgcaccaugucgaagaccaagcggaugggcauggggcuguacgugaaguaugacggcgaccccugggccgacuccgacgcgcugguccucagcggggugaugguguccauggaggagccgggcugguacaguuucggguucgagaucaaggacaagaagugcgacguccccugcaucggcaucgagauggugcaugacggcgggaaggagacguggcacuccgccgccaccgccaucuacugccugaugggcagcgggcagcugcucugggacaccgugaccggcgucgacauggcccuguga

SEQ ID NO: 29355 - RNA, 1401 nt, Artificial Sequence
  derived and/or modified CDS sequence (AUadapt) from InfluenzaB__AGX17459__NA
augcugcccaguaccauccagacccucacgcuguuccugaccuccggcggggugcuccugagccuguacgucuccgccagccucuccuaccugcuguacagugacauccuccugaaguucuccccgaccgagaucaccgccagcacgaugccccuggacugcgcgaacgccuccaaugugcaggccgugaaccgcagcgccaccaagggcgucacccuccugcugcccgagcccgacuggaccuacccgcggcucuccugccccgggucgacguuucagaaggcccugcugaucagcccccaccgcuucggcgagaccaaggggaacuccgcgccccucaucauccgggagccguucaucgccugcggccccaaggagugcaagcauuucgcccugacccacuacgccgcgcagcccggcggguacuacaacggcacccgcggggaucggaacaagcugcgccaccucaucuccgugaagcugggcaagauccccacgguggagaacagcaucuuccacauggccgccugguccgggagugccugccacgacggcaaggaguggaccuacaucggcgucgacgggccggacaacaaugcccugcucaagaucaaguacggcgaggcguacaccgacaccuaccacuccuacgccaauaacauccugcggacgcaggagucggccugcaacugcaucgggggcaacuguuaccugaugaucaccgacggcagcgccuccgggaucagcgagugccgcuuccucaagauccgggagggccgcaucaucaaggagaucuuucccaccgggcgggugaagcacaccgaggagugcacgugcggcuucgccuccaacaagaccaucgagugcgcgugccgcgauaacucguacaccgccaagcggcccuucgugaagcugaacgucgagaccgacacggccgagauccgccugauguguaccgagaccuaccucgacacgccccggccggacgacggguccaucaccggccccugcgagagcaauggcgacaagggguccggcgggaucaagggcggguucgugcaccagcgcauggccagcaagaucggccggugguacucccgcaccaugucgaagaccaagcggaugggcauggggcuguacgugaaguaugacggcgaccccugggccgacuccgacgcgcuggcccucagcggggucaugguguccauggaggagcccggcugguacaguuucggguucgagaucaaggacaagaagugcgacgugccgugcaucggcaucgagaugguccaugacggcgggaaggagaccuggcacuccgccgccacggccaucuacugccugaugggcagcgggcagcugcucugggacaccgugaccggcguggacauggcgcuguga

SEQ ID NO: 29356 - RNA, 1401 nt, Artificial Sequence; identical to SEQ ID NO: 28727
  derived and/or modified CDS sequence (AUadapt) from InfluenzaB__AGX17470__NA

SEQ ID NO: 29357 - RNA, 1401 nt, Artificial Sequence
  derived and/or modified CDS sequence (AUadapt) from InfluenzaB__AGX17481__NA
augcugcccaguaccauccagacccucacgcuguuccugaccuccggcggggugcuccugagccuguacgucuccgccagccucuccuaccugcuguauucggacauccuccugaaguucuccccgaccgagaucaccgcccccacgaugccccuggacugcgcgaacgccaguaacgugcaggccgugaaccgcuccgccaccaagggcgucacccucauccugcccgagccggaguggaccuacccccggcugagcugccccggguccacguuccagaaggcccuccugaucaguccccaccgcuucggcgagaccaaggggaacuccgcgccgcugaucauccgggagcccuucaucgccugcggccccaaggagugcaagcauuucgcccucacccacuacgccgcgcagcccggcggguacuacaauggcacccgcggggaccggaacaagcugcgccaccugaucucggugaagcucggcaagaucccgacgguggagaacuccaucuuccauauggccgccuggagcggguccgccugccacgacggcaaggaguggaccuacaucggcgucgacgggcccgauaacaacgcccugcugaagaucaaguacggcgaggcguacaccgacaccuaccauagcuacgccaacaacauccuccggacgcaggaguccgccugcaacuguaucgggggcaacugcuaccugaugaucaccgacggcagcgccagugggaucuccgagugccgcuuccugaagauccgggagggccgcaucaucaaggagaucuuccccaccgggcgggugaagcacaccgaggagugcacgugcggcuuugccagcaacaagaccaucgagugcgcgugccgcgacaacuccuauaccgccaagcggcccuucgugaagcucaacgucgagaccgacacggccgagauccgccugaugugcaccgagaccuaccuggacaccccgcggcccgaugacgggagcaucacgggccccugcgaguccaacggcgacaaggggaguggcgggaucaagggcggguucgugcaccagcgcauggccuccaagaucggccggugguacucgcgcaccauguccaagaccaagcggaugggcauggggcucuacgugaaguacgauggcgaccccugggccgacagcgacgcgcuggcccuguccggggucauggugagcguggaggagccgggcugguacuccuuuggguucgagaucaaggacaagaagugcgacguccccugcaucggcaucgagauggugcacgauggcgggaaggagaccuggcacagcgccgccacggccaucuacugccucaugggcuccgggcagcugcugugggacaccgugaccggcgucgacauggcgcucuga

SEQ ID NO: 29358 - RNA, 1401 nt, Artificial Sequence
  derived and/or modified CDS sequence (AUadapt) from InfluenzaB__AGX17492__NA
augcugcccaguaccauccagacccucacgcuguuccugaccuccggcggggugcuccugagccuguacgucuccgccagccucuccuaccugcuguauucggacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaaggagugcaagcauuucgcccugacccacuacgccgcgcagcccggcggguacuacaauggcacccgcggggaccggaacaagcugcgccaccucaucucggugaagcugggcaagaucccgacgguggagaacuccaucuuccauauggccgccuggagcggguccgccugccacgacggcaaggaguggaccuacaucggcgucgacgggcccgauaacaacgcccugcucaagaucaaguacggcgaggcguacaccgacaccuaccauagcuacgccaacaacauccugcggacgcaggaguccgccugcaacuguaucgggggcaacugcuaccugaugaucaccgacggcagcgccagugggaucuccgagugccgcuuccucaagauccgggagggccgcaucaucaaggagaucuuccccaccgggcgggugaagcacaccgaggagugcacgugcggcuuugccagcaacaagaccaucgagugcgcgugccgcgacaacuccuauaccgccaagcggcccuucgugaagcugaacgucgagaccgacacggccgagauccgccugaugugcaccgagaccuaccucgacaccccgcggcccgaugacgggagcaucacgggccccugcgaguccaacggcgacaaggggaguggcgggaucaagggcggguucgugcaccagcgcauggccuccaagaucggccggugguacucgcgcaccauguccaagaccaagcggaugggcauggggcuguacgugaaguacgauggcgaccccugggccgacagcgacgcgcuggcccucuccggggucauggugagcauggaggagccgggcugguacuccuuuggguucgagaucaaggacaagaagugcgacgugcccugcaucggcaucgagaugguccacgauggcgggaaggagaccuggcacagcgccgccacggccaucuacugccugaugggcuccgggcagcugcucugggacaccgugaccggcguggacaucgcgcuguga

SEQ ID NO: 29359 - RNA, 1401 nt, Artificial Sequence
  derived and/or modified CDS sequence (AUadapt) from InfluenzaB__AGX17503__NA
augcugcccaguaccauccagacccucacgcuguuccugaccuccggcggggugcuccugagccuguacgucuccgccagccucuccuaccugcuguauucggacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccgggcugacguuccagaaggcccugcucaucaguccccaccgcuucggcgagaccaaggggaacuccgcgccgcugaucauccgggagcccuucaucgccugcggccccaaggagugcaagcauuucgcccugacccacuacgccgcgcagcccggcggguacuacaauggcacccgcggggaccggaacaagcuccgccaccugaucuccgugaagcugggcaagaucccgacgguggagaacucgaucuuccauauggccgccugguccgggagcgccugccacgacggcaaggaguggaccuacaucggcgucgacgggcccgauaacaacgcccuccugaagaucaaguacggcgaggcguacaccgacaccuaccauuccuacgccaacaacauccugcggacgcaggagagcgccugcaacuguaucgggggcaacugcuaccucaugaucaccgacggcuccgccagcgggaucagugagugccgcuuccugaagauccgggagggccgcaucaucaaggagaucuuccccaccgggcgggugaagcacaccgaggagugcacgugcggcuuugccuccaacaagaccaucgagugcgcgugccgcgacaacagcuauaccgccaagcggcccuucgugaagcugaacgucgagaccgacacggccgagauccgccucaugugcaccgagaccuaccuggacaccccgcggcccgaugacggguccaucacgggccccugcgagagcaacggcgacaagggguccggcgggaucaagggcggguuugugcaccagcgcauggccagcaagaucggccggugguacucccgcaccaugucgaagaccaagcggaugggcauggggcuguacgugaaguacgauggcgaccccugggccgacuccgacgcgcucgcccugagcggggucaugguguccauggaggagccgggcugguacagcuuuggguucgagaucaaggacaagaagugcgacgugcccugcaucggcaucgagaugguccacgauggcgggaaggagaccuggcacuccgccgccacggccaucuacugccugaugggcagcgggcagcuccugugggacaccgugaccggcguggacauggcgcuguga

SEQ ID NO: 29360 - RNA, 1401 nt, Artificial Sequence; identical to SEQ ID NO: 28727
  derived and/or modified CDS sequence (AUadapt) from InfluenzaB__AGX17514__NA

SEQ ID NO: 29361 - RNA, 1401 nt, Artificial Sequence
  derived and/or modified CDS sequence (AUadapt) from InfluenzaB__AGX17525__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccucgaacgugcaggccgugaaccgcuccgccaccaagggcgucacccuccugcugcccgagccggaguggaccuacccccggcucagcugccccggguccacguuucagaaggcccugcugaucagcccccaccgcuucggcgagaccaaggggaacuccgcgccgcucaucauccgggagcccuucaucgccuguggccccaaggagugcaagcacuucgcccugacccacuacgccgcgcagcccggcggguacuauaacggcaagcgcggggaccggaacaagcugcgccaccucaucagcgugaagcugggcaagaucccgaccguggagaauuccaucuuccacauggccgccuggagcggguccgccugccacgauggcaaggaguggacguacaucggcgucgacgggcccgacaacaacgcccugcucaagaucaaguacggcgaggcguauaccgacaccuaccacucguacgccaauaacauccugcggacccaggaguccgccugcaacugcaucgggggcaacugcuaucugaugaucacggacggcagcgccagcgggaucuccgagugccgcuuccucaagauccgggagggccgcaucaucaaggagaucuuucccaccgggcgggugaagcacaccgaggagugcacgugcggcuucgccagcaacaagaccaucgagugugcgugccgcgacaacuccuacaccgccaagcggcccuucgugaagcugaaugucgagaccgacaccgccgagauccgccugaugugcacggagaccuaccucgacaccccgcggcccgacgaugggagcaucaccggccccugcgaguccaacggcgacaaggggucgggcgggaucaagggcggguucgugcaucagcgcauggccuccaagaucggccggugguacagccgcacgauguccaagaccaagcggaugggcauggggcuguacgugaaguacgacggcgaucccugggccgacagcgacgcgcuggcccucuccggggucauggugagcauggaggagccgggcugguacuccuucggguuugagauccgcgacaagaagugcgacgugcccugcaucggcaucgagaugguccacgauggcgggaaggagaccuggcacagcgccgccaccgccaucuacugccugaugggcuccgggcagcugcucugggacacggugaccggcguggacauggcgcuguga

SEQ ID NO: 29362 - RNA, 1401 nt, Artificial Sequence; identical to SEQ ID NO: 29306
  derived and/or modified CDS sequence (AUadapt) from InfluenzaB__AGX17536__NA

SEQ ID NO: 29363 - RNA, 1401 nt, Artificial Sequence; identical to SEQ ID NO: 29337
  derived and/or modified CDS sequence (AUadapt) from InfluenzaB__AGX17547__NA

SEQ ID NO: 29364 - RNA, 1401 nt, Artificial Sequence
  derived and/or modified CDS sequence (AUadapt) from InfluenzaB__AGX17558__NA
augcugcccaguaccauccagacccucacgcuguuccugaccuccggcggggugcuccugagccuguacgucuccgccagccucuccuaucugcuguacagcgacgugcuccugaaguucuccccggccgagaucaccgcgcccaccaugccccuggacugugccaacgccagcaacgugcaggccgucaaccgcuccgccacgaagggcgugacccuccugcugcccgagccggaguggaccuacccccggcucaguugccccggguccaccuuccagaaggcgcugcugaucagcccccaccgcuucggcgagacgaaggggaauuccgccccgcucaucauccgggagcccuucaucgccugcggccccaaggagugcaagcacuucgcccugacccauuacgcggcccagcccggcggguacuacaacggcacccgcggggaucggaacaagcugcgccaccucaucagcgugaagcugggcaagaucccgaccgucgagaacuccaucuuccauauggccgccuggagcggguccgccugccacgacggcaaggaguggacguacaucggcguggaugggcccgacaacaacgcgcugcucaagaucaaguacggcgaggccuacaccgauaccuaccacucguacgccaacaauauccugcggacccaggaguccgccugcaacugcaucgggggcaacuguuaccugaugaucacggacggcagcgccagcgggguguccgagugccgcuuucucaagauccgggagggccgcaucaucaaggagaucuuccccaccgggcgggucaagcacaccgaggagugcacgugcggcuucgcgaguaacaagaccaucgagugcgccugccgcgacaacuccuauaccgccaagcggcccuucgugaagcugaacguggagaccgacaccgccgagauccgccugaugugcacggagaccuaccucgauaccccgcggcccgacgacgggagcaucaccggccccugcgaguccaauggcgacaaggggagcggcgggaucaagggcggguucguccaccagcgcauggccuccaagaucggccggugguacagucgcacgauguccaagaccaagcggaugggcauggggcuguacgugaaguacgacggcgaccccugggcggacagugacgcccuggcccucuccggggugauggucagcauggaggagccgggcugguacuccuucggguucgagaucaaggauaagaagugcgacgugcccugcaucggcaucgagauggugcacgacggcgggaaggagaccuggcauagcgccgccaccgcgaucuacugccugaugggcuccgggcagcugcucugggacacggucaccggcguggacauggcccuguga

SEQ ID NO: 29365 - RNA, 1401 nt, Artificial Sequence; identical to SEQ ID NO: 28856
  derived and/or modified CDS sequence (AUadapt) from InfluenzaB__AGX17569__NA

SEQ ID NO: 29366 - RNA, 1401 nt, Artificial Sequence; identical to SEQ ID NO: 28783
  derived and/or modified CDS sequence (AUadapt) from InfluenzaB__AGX17580__NA

SEQ ID NO: 29367 - RNA, 1401 nt, Artificial Sequence
  derived and/or modified CDS sequence (AUadapt) from InfluenzaB__AGX17591__NA
augcugcccaguaccauccagacccucacgcuguuccugaccuccggcggggugcuccugagccuguacgucuccgccagccucuccuaccugcuguauucggacauccuccugaaguucccgcccaccgagaucaccgcccccacgaugccccuggacugcgcgaacgccuccaaugugcaggccgugaaccgcagcgccaccaagggcgucacccuccugcugccggagcccgaguggaccuacccccggcucuccugccccgggagcacguuccagaaggcccugcugaucuccccgcaucgcuucggcgagaccaaggggaacagcgcgccccucaucauccgggagcccuucaucgccugcggccccaaggagugcaagcauuucgcccugacccacuacgccgcgcagccgggcggguacuacaacggcacccgcggggaucggaacaagcugcgccaccucaucuccgugaagcugggcaagauccccacgguggagaacucgaucuuccacauggccgccugguccgggagugccugccacgacggcaaggaguggaccuacaucggcgucgacgggcccgauaacaacgcccugcucaagaucaaguacggcgaggcguacaccgacaccuaccauuccuacgccaacaacauccugcggacgcaggagagcgccugcaacuguaucgggggcaacugcuaccugaugaucaccgacggcuccgccagcggggugucggagugucgcuuccucaagauccgggagggccgcaucaucaaggagaucuuccccaccgggcgggugaagcacaccgaggagugcacgugcggcuucgccuccaauaagaccaucgagugcgcgugccgcgacaacagcuacaccgccaagcggccguuugucaagcugaacguggagaccgacacggccgagauccgccugaugugcaccgagaccuaccucgacacgccccggcccgaugacggguccaucaccggccccugcgagagcaacggcgacaagggguccggcgggaucaagggcggguucgugcaucagcgcauggccagcaagaucggccggugguacucccgcaccaugucgaagaccaagcggaugggcauggggcuguacgucaaguacgacggcgauccgugggccgacuccgacgcgcuggccuucagcggggugaugguguccauggaggagcccggcugguacagcuuuggguucgagaucaaggacaagaagugcgacguccccugcaucggcaucgagauggugcacgauggcgggaaggagaccuggcacuccgccgccacggccaucuacugccucaugggcagcgggcagcugcugugggacaccgugaccggcgucaacauggcgcucuga

SEQ ID NO: 29368 - RNA, 1401 nt, Artificial Sequence; identical to SEQ ID NO: 28781
  derived and/or modified CDS sequence (AUadapt) from InfluenzaB__AGX17602__NA

SEQ ID NO: 29369 - RNA, 1401 nt, Artificial Sequence; identical to SEQ ID NO: 29367
  derived and/or modified CDS sequence (AUadapt) from InfluenzaB__AGX17613__NA

SEQ ID NO: 29370 - RNA, 1401 nt, Artificial Sequence; identical to SEQ ID NO: 28954
  derived and/or modified CDS sequence (AUadapt) from InfluenzaB__AGX17624__NA

SEQ ID NO: 29371 - RNA, 1401 nt, Artificial Sequence
  derived and/or modified CDS sequence (AUadapt) from InfluenzaB__AGX17635__NA
augcugcccaguaccauccagacccucacgcuguuccugaccuccggcggggugcuccugagccuguacgucuccgccagccucuccuaccugcuguacagugacauccuccugaaguucccgcccaccgagaucaccgcccccacgaugccccuggacugcgcgaacgccuccaacgugcaggccgugaaucgcagcgccaccaagggcgucacccuccugcugccggagcccgaguggaccuacccccggcucuccugccccgggagcacguuccagaaggcccugcugaucuccccgcaccgcuuuggcgagaccaaggggaacucggcgccccucaucauccgggagcccuucaucgccugcggccccaaggagugcaagcacuuugcccugacccacuacgccgcgcagccgggcggguacuacaacggcacccgcggggaccggaacaagcugcgccaucucaucuccgugaagcugggcaagauccccacgguggagaacagcaucuuccacauggccgccugguccgggagcgccugccaugacggcaaggaguggaccuacaucggcgucgacgggcccgacaacaacgcccugcucaagaucaaguauggcgaggcguacaccgacaccuaccacuccuacgccaacaauauccugcggacgcaggagucggccugcaacugcaucgggggcaacugcuaccugaugaucaccgauggcuccgccagcgggaucagcgagugccgcuuccucaagauccgggagggccgcaucaucaaggagaucuuccccaccgggcgggugaagcacaccgaggaguguacgugcggcuucgccuccaacaagaccaucgagugcgcgugccgcgacaauucguacaccgccaagcggccguucgugaagcugaacgucgagaccgacacggccgagauccgccugaugugcaccgagaccuaucucgacacgccccggcccgacgacggguccaucaccggccccugcgagagcaacggcgacaagggguccggcgggaucaagggcggguuugugcaccagcgcauggccagcaagaucggccggugguacucccgcaccaugucgaagaccaagcggaugggcauggggcuguacgugaaguacgauggcgacccgugggccgacuccgacgcgcuggccuucagcggggucaugguguccauggaggagcccggcugguacaguuucggguucgagaucaaggacaagaagugcgacgugcccugcaucggcaucgagaugguccaugacggcgggaaggagaccuggcacuccgccgccacggccaucuacugccucaugggcagcgggcagcugcugugggacaccgugaccggcgugaacauggcgcucuga

SEQ ID NO: 29372 - RNA, 1401 nt, Artificial Sequence; identical to SEQ ID NO: 28954
  derived and/or modified CDS sequence (AUadapt) from InfluenzaB__AGX17657__NA

SEQ ID NO: 29373 - RNA, 1401 nt, Artificial Sequence; identical to SEQ ID NO: 29367
  derived and/or modified CDS sequence (AUadapt) from InfluenzaB__AGX17668__NA

SEQ ID NO: 29374 - RNA, 1401 nt, Artificial Sequence
  derived and/or modified CDS sequence (AUadapt) from InfluenzaB__AGX17679__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccucgaaugugcaggccgugaaccgcuccgccaccaagggcgucacccuccugcugcccgagccggaguggaccuacccccggcucagcugccccggguccacguuccagaaggcccugcugaucagcccccaccgcuuuggcgagaccaaggggaacuccgcgccgcucaucauccgggagcccuucaucgccugcggccccaacgagugcaagcacuuugcccugacccacuacgccgcgcagcccggcggguacuacaacggcacccgcggggaccggaauaagcugcgccaccucaucagcgugaagcugggcaagaucccgacgguggagaacuccaucuuccacauggccgccuggagcggguccgccugccaugacggcaaggaguggaccuacaucggcgucgacgggcccgacaacaacgcccugcucaagaucaaguauggcgaggcguacaccgacaccuaccacucguacgccaauaacauccugcggacgcaggaguccgccugcaacugcaucgggggcaacugcuaccugaugaucaccgauggcagcgccagcgggguguccgagugccgcuuccucaagauccgggagggccgcaucaucaaggagaucuuccccaccgggcgggugaagcacaccgaggaguguacgugcggcuucgccagcaacaagaccaucgagugcgcgugccgcgauaacuccuacaccgccaagcggcccuucgucaagcugaacguggagaucgacaccgccgagauccgccugaugugcacggacaccuaucucgacaccccgcggcccgacgacgggagcaucaccggccccugcgaguccaacggcgauaaggggucgggcgggaucaagggcggguucgugcaccagcgcauggccuccaagaucggccggugguacagccgcacgauguccaagaccgagcggaugggcauggggcuguacgucaaguaugacggcgaccccugggccgacagcgacgcgcuggccuucuccggggugauggugagcaugaaggagccgggcugguauuccuucggguucgagaucaaggacaagaagugcgacguccccugcaucggcaucgagauggugcaugacggcgggaaggagaccuggcacagcgccgccaccgccaucuacugccucaugggcuccgggcagcugcugugggacacggugaccggcgucgacauggcgcucuga

SEQ ID NO: 29375 - RNA, 1401 nt, Artificial Sequence; identical to SEQ ID NO: 28954
  derived and/or modified CDS sequence (AUadapt) from InfluenzaB__AGX17690__NA

SEQ ID NO: 29376 - RNA, 1401 nt, Artificial Sequence
  derived and/or modified CDS sequence (AUadapt) from InfluenzaB__AGX17701__NA
augcugcccaguaccauccagacccucacgcuguuccugaccuccggcggggugcuccugagccuguacgucuccgccagccucuccuaccugcuguacagugacauccuccugaaguucccgcccaccgagaucaccgcccccacgaugccccuggacugcgcgaacgccuccaacgugcaggccgugaaucgcagcgccaccaagggcgucacccuccugcugccggagcccgaguggaccuacccccggcucuccugccccgggagcacguuccagaaggcccugcugaucuccccgcaccgcuuuggcgagaccaaggggaacucggcgccccucaucauccgggagcccuucaucgccugcggccccaaggagugcaagcacuuugcccugacccacuacgccgcgcagccgggcggguacuacaacggcaagcgcggggaccggaacaagcugcgccaucucaucuccgugaagcugggcaagauccccaccguggagaacagcaucuuccacauggccgccugguccgggagcgccugccaugacggcaaggaguggacguacaucggcgucgacgggcccgacaacaacgcccugcucaagaucaaguauggcgaggcguacaccgacaccuaccacuccuacgccaacaauauccugcggacccaggagucggccugcaacugcaucgggggcaacugcuaccugaugaucacggauggcuccgccagcggggugagcgagugccgcuuccucaagauccgggagggccgcaucaucaaggagaucuuccccaccgggcgggugaagcacaccgaggaguguacgugcggcuucgccuccaacaagaccaucgagugcgcgugccgcgacaauucguacaccgccaagcggccguucgucaagcugaacguggagaccgacaccgccgagauccgccugaugugcacggagaccuaucucgacacgccccggcccgacgacggguccaucaccggccccugcgagagcaacggcgacaagggguccggcgggaucaagggcggguuugugcaccagcgcauggccagcaagaucggccggugguacucccgcaccaugucgaagaccaagcggaugggcauggggcuguacgucaaguacgauggcgacccgugggccgacuccgacgcgcuggccuucagcggggugaugguguccauggaggagcccggcugguacaguuucggguucgagaucaaggacaagaagugcgacguccccugcaucggcaucgagauggugcaugacggcgggaaggagaccuggcacuccgccgccaccgccaucuacugccucaugggcagcgggcagcugcugugggacacggugaccggcgucaacauggcgcucuga

SEQ ID NO: 29377 - RNA, 1401 nt, Artificial Sequence; identical to SEQ ID NO: 28954
  derived and/or modified CDS sequence (AUadapt) from InfluenzaB__AGX17723__NA

SEQ ID NO: 29378 - RNA, 1401 nt, Artificial Sequence; identical to SEQ ID NO: 29374
  derived and/or modified CDS sequence (AUadapt) from InfluenzaB__AGX17734__NA

SEQ ID NO: 29379 - RNA, 1401 nt, Artificial Sequence
  derived and/or modified CDS sequence (AUadapt) from InfluenzaB__AGX17745__NA
augcugcccaguaccauccagacccucacgcuguuccugaccuccggcggggugcuccugagccuguacgucuccgccagccucuccuaccugcuguacagugacauccuccugaaguucccgcccaccgagaucaccgcccccacgaugccccuggacugcgcgaacgccuccaacgugcaggccgugaaccgcagugccaccaagggcgucacccuccugcugccggagcccgaguggaccuacccccggcucuccugcagcggguccacguuccagaaggcccugcugaucagcccccaccgcuucggcgagaucaaggggaauuccgcgccgcucaucauccgggagcccuucaucgccugcggccccaaggagugcaagcacuucgcccugacccacuaugccgcgcagcccggcggguacuacaacggcacccgcggggaccggaacaagcugcgccaccucaucucggugaagcugggcaagaucccgaccguggagaauuccaucuuccacauggccgccuggagcggguccgccugccacgacggcaaggaguggacguacaucggcgucgaugggcccgacaacaacgcccugcucaagaucaaguacggcgaggcguacaccgacaccuaucacagcuacgccaacaacauccugcggacccaggaguccgccugcaacuguaucgggggcaacugcuaccugaugaucacggacggcagcgccucggggguguccgagugccgcuuucucaagauccgggagggccgcaucaucaaggagaucuuccccaccgggcgggugaagcacaccgaggagugcacgugcggcuucgccagcaauaagaccaucgagugcgcgugccgcgacaacuccuacaccgccaagcggcccuucgucaagcugaacguggagaccgauaccgccgagauccgccugaugugcacggagaccuaccucgacaccccgcggcccgacgacgggagcaucaccggccccugcgaguccaauggcgacaaggggagcggcgggaucaagggcggguucgugcaccagcgcauggccuccaagaucggccggugguacucgcgcacgauguccaagaccaagcggaugggcauggggcuguaugucaaguacgacggcgaccccugggccgacagcgacgcgcuggccuucuccggggugauggugaguauggaggagccgggcugguacuccuucggguucgagaucaaggacaagaagugcgacguccccugcaucggcaucgagauggugcaugacggcgggaaggagaccuggcacagcgccgccaccgccaucuacugccucaugggcuccgggcagcugcugugggacacggugaccggcgucaacauggcgcucuga

SEQ ID NO: 29380 - RNA, 1401 nt, Artificial Sequence
  derived and/or modified CDS sequence (AUadapt) from InfluenzaB__AGX17756__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcacgccgugaaccgcuccgccaccaagggcgucacccuccugcugcccgagccggaguggaccuacccccggcucagcugucccggguccacguuccagaaggcccugcugaucucgccccaccgcuucggcgagaccaaggggaacuccgcgccgcucaucauccgggagcccuucaucgccuguggccccaacgagugcaagcacuucgcccugacccacuacgccgcgcgccccggcggguauuacaacggcacccgcggggaccggaacaagcugcggcaccucaucagugugaagcugggcaagaucccgacgguggagaacuccaucuuccacauggccgccuggagcggguccgccugccacgauggcaaggaguggaccuacaucggcgucgacgggcccgacaacaacgcccugcucaagaucaaguacggcgaggcguauaccgacaccuaccacagcuacgccaauaacauccugcgcacgcaggaguccgccugcaacugcaucgggggcaacugcuaucugaugaucaccgacggcagcgccagcgggguguccgagugccgguuccucaagauccgcgagggccggaucaucaaggagaucuuucccaccgggcgcgugaagcacaccgaggagugcacgugcggcuucgccucgaacaagaccaucgagugugcgugccgggacaacuccuacaccgccaagcgccccuucgucaagcugaacguggagaccgauacggccgagauccggcugaugugcaccgacaccuaccucgacaccccgcgccccgacgaugggagcaucacgggccccugcgaguccaacggcgacaaggggagcggcgggaucaagggcggguucgugcaucagcggauggccuccaagaucggccgcugguacagccggaccauguccaagaccgagcgcaugggcauggggcuguacgucaaguacgacggcgaccccugggccgauagcgacgcgcuggccuucuccggggugauggugagcaugaaggagccgggcugguacuccuuuggguucgagaucaaggacaagaagugcgacguccccugcaucggcaucgagauggugcacgauggcgggaaggagaccuggcacagcgccgccacggccaucuacugccucaugggcuccgggcagcugcugugggacaccgugaccggcgucgacauggcgcucuga

SEQ ID NO: 29381 - RNA, 1401 nt, Artificial Sequence; identical to SEQ ID NO: 29001
  derived and/or modified CDS sequence (AUadapt) from InfluenzaB__AGX17767__NA

SEQ ID NO: 29382 - RNA, 1401 nt, Artificial Sequence
  derived and/or modified CDS sequence (AUadapt) from InfluenzaB__AGX17778__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcacgccgugaaccgcuccgccaccaagggcgucacccuccugcugcccgagccggaguggaccuacccccggcucagcugccccggguccacguuucagaaggcccugcugaucagcccccaccgcuucggcgagaccaaggggaacuccgcgccgcucaucauccgggagcccuucaucgccugcggccccaaugagugcaagcacuucgcccugacccacuacgccgcgcagcccggcggguacuauaacggcacccgcggggaccggaacaagcugcgccaccucaucagcgugaagcugggcaagaucccgacgguggagaacuccaucuuucacauggccgccuggagcggguccgccugccacgacggcaaggaguggaccuacaucggcgucgaugggcccgacaacaacgcccugcucaagaucaaguacggcgaggcguacaccgacaccuaucacucguacgccaacaacauccugcggacgcaggaguccgccugcaauugcaucgggggcaacugcuaccugaugaucaccgacggcagcgccagugggguguccgagugccgcuuccucaagauccgggagggccgcaucaucaaggagaucuuccccaccgggcgggugaagcacaccgaggagugcacgugcggcuuugccagcaacaagaccaucgagugcgcgugccgcgacaacuccuauaccgccaagcggcccuucgucaagcugaacguggagaccgacacggccgagauccgccugaugugcaccgacaccuaccucgauaccccgcggcccgacgacgggagcaucacgggccccugcgaguccaacggcgacaaggggaguggcgggaucaagggcggguucgugcaccagcgcauggccuccaagaucggccggugguacagccgcaccauguccaagaccgagcggaugggcauggggcuguacgucaaguacgauggcgaccccugggccgagagcgacgcgcuggccuucuccggggugauggugagcaugaaggagccgggcugguacuccuuuggguucgagaucaaggacaagaagugcgacguccccugcaucggcaucgagauggugcacgauggcgggaaggagaccuggcacagcgccgccacggccaucuacugccucaugggcuccgggcagcugcugugggacaccgugaccggcgucgacauggcgcucuga

SEQ ID NO: 29383 - RNA, 1401 nt, Artificial Sequence
  derived and/or modified CDS sequence (AUadapt) from InfluenzaB__AGX17789__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccucgaacgugcaggccgugaaucgcuccgccaccaagggcgucacccuccugcugcccgagccggaguggaccuacccccggcucagcugccccggguccacguuccagaaggcccugcugaucagcccccaccgcuucggcgagaccaaggggaauuccgcgccgcucaucauccgggagcccuucaucgccugcggccccaacgagugcaagcacuucgcccugacccacuaugccgcgcagcccggcggguacuacaacggcacccgcggggaccggaacaagcugcgccaccucaucagcgugaagcugggcaagaucccgacgguggagaauuccaucuuccacauggccgccuggagcggguccgccugccacgacggcaaggaguggaccuauaucggcgucgacgggcccgacaacaacgcccugcucaagaucaaguacggcgaggcguacaccgacaccuaucacucguacgccaacaacauccugcggacgcaggaguccgccugcaacuguaucgggggcaacugcuaccugaugaucaccgacggcagcgccagcgggguguccgagugccgcuuucucaagauccgggagggccgcaucaucaaggagaucuuccccaccgggcgggugaagcacaccgaggagugcacgugcggcuucgccagcaacaagaccaucgagugugcgugccgcgacaacuccuacaccgccaagcggcccuucgucaagcugaacguggagaucgauaccgccgagauccgccugaugugcacggacaccuaccucgacaccccgcggcccgacgacgggagcaucaccggccccugugaguccaacggcgacaaggggucgggcgggaucaagggcggguucgugcaccagcgcauggccuccaagaucggccggugguacagccgcacgauguccaagaccgagcggaugggcauggggcuguaugucaaguacgacggcgaccccugggccgacagcgacgcgcugguguucuccggggugauggucaguaugaaggagccgggcugguacuccuucggguucgagaucaaggacaagaagugcgacgugcccugcaucggcaucgagauggugcaugacggcgggaaggagaccuggcacagcgccgccaccgccaucuacugccucaugggcuccgggcagcugcugugggacacggucaccggcguggacauggcccucuga

SEQ ID NO: 29384 - RNA, 1401 nt, Artificial Sequence; identical to SEQ ID NO: 28954
  derived and/or modified CDS sequence (AUadapt) from InfluenzaB__AGX17800__NA

SEQ ID NO: 29385 - RNA, 1401 nt, Artificial Sequence
  derived and/or modified CDS sequence (AUadapt) from InfluenzaB__AGX17811__NA
augcugcccaguaccauccagacccucacgcuguuccugaccuccggcggggugcuccugagccuguacgucuccgccagccucuccuaccugcuguauucggacauccuccugaaguucccgcccaccgagaucaccgcccccacgaugccccuggacugcgcgaacgccuccaaugugcaggccgugaaccgcagcgccaccaagggcgucacccuccugcugccggagcccgaguggaccuacccccggcucuccugccccgggagcacguuccagaaggcccugcugaucuccccgcaucgcuucggcgagaccaaggggaacucggcgccccucaucauccgggagcccuucaucgccugcggccccaaggagugcaagcauuucgcccugacccacuacgccgcgcagccgggcggguacuacaacggcacccgcggggaucggaacaagcugcgccaccucaucuccgugaagcugggcaagauccccacgguggagaacagcaucuuccacauggccgccugguccgggagugccugccacgacggcaaggaguggaccuacaucggcgucgacgggcccgauaacaacgcccugcucaagaucaaguacggcgaggcguacaccgacaccuaccauuccuacgccaacaacauccugcggacgcaggagucggccugcaacuguaucgggggcaacugcuaccugaugaucaccgacggcuccgccagcggggugagcgagugucgcuuccucaagauccgggagggccgcaucaucaaggagaucuuccccaccgggcgggugaagcacaccgaggagugcacgugcggcuucgccuccaauaagaccaucgagugcgcgugccgcgacaacucguacaccgccaagcggccguuugucaagcugaacguggagaccgacacggccgagauccgccugaugugcaccgagaccuaccucgacacgccccggcccgaugacggguccaucaccggccccugcgagagcaacggcgacaagggguccggcgggaucaagggcggguucgugcaucagcgcauggccagcaagaucggccggugguacucccgcaccaugucgaagaccaagcggaugggcauggggcuguacgucaaguacgacggcgauccgugggccgacuccgacgcgcuggccuucagcggggugaugguguccauggaggagcccggcugguacagcuuuggguucgagaucaaggacaagaagugcgacguccccugcaucggcaucgagauggugcacgauggcgggaaggagaccuggcacuccgccgccacggccaucuacugccucaugggcagcgggcagcugcugugggacaccgugaccggcgucaacauggcgcaguga

SEQ ID NO: 29386 - RNA, 1401 nt, Artificial Sequence; identical to SEQ ID NO: 29367
  derived and/or modified CDS sequence (AUadapt) from InfluenzaB__AGX17822__NA

SEQ ID NO: 29387 - RNA, 1401 nt, Artificial Sequence
  derived and/or modified CDS sequence (AUadapt) from InfluenzaB__AGX17833__NA
augcugcccaguaccauccagacccucacgcuguuccugaccuccggcggggugcuccugagccuguacgucuccgccagccucuccuaccugcuguacagugacauccuccugaaguucccgcccaccgagaucaccgcccccacgaugccccuggacugcgcgaacgccuccaacgugcaggccgugaaucgcagcgccaccaagggcgucacccuccugcugccggagcccgaguggaccuacccccggcucuccugccccgggagcacguuccagaaggcccugcugaucuccccgcaccgcuuuggcgagaccaaggggaacucggcgccccucaucauccgggagcccuucaucgccugcggccccaaggagugcaagcacuuugcccugacccacuacgccgcgcagccgggcggguacuacaacggcacccgcggggaccggaacaagcugcgccaucucaucuccaucaagcugggcaagauccccacgguggagaacagcaucuuccacauggccgccugguccgggagcgccugccaugacggcaaggaguggaccuacaucggcguggacgggcccgacaacaacgcccugcucaagaucaaguauggcgaggcguacaccgacaccuaccacuccuacgccaacaauauccugcggacgcaggagucggccugcaacugcaucgggggcaacugcuaccugaugaucaccgauggcuccgccagcggggucagcgagugccgcuuccucaagauccgggagggccgcaucaucaaggagaucuuccccaccgggcgggugaagcacaccgaggaguguacgugcggcuucgccuccaacaagaccaucgagugcgcgugccgcgacaauucguacaccgccaagcggccguucgugaagcugaacgucgagaccgacacggccgagauccgccugaugugcaccgagaccuaucucgacacgccccggcccgacgacggguccaucaccggccccugcgagagcaacggcgacaagggguccggcgggaucaagggcggguuugugcaccagcgcauggccagcaagaucggccggugguacucccgcaccaugucgaagaccaagcggaugggcauggggcuguacgugaaguacgauggcgacccgugggccgacuccgacgcgcuggccuucagcggggucaugguguccauggaggagcccggcugguacaguuucggguucgagaucaaggacaagaagugcgacgugcccugcaucggcaucgagaugguccaugacggcgggaaggagaccuggcacuccgccgccacggccaucuacugccucaugggcagcgggcagcugcugugggacaccgugaccggcgugaacauggcgcucuga

SEQ ID NO: 29388 - RNA, 1401 nt, Artificial Sequence; identical to SEQ ID NO: 29374
  derived and/or modified CDS sequence (AUadapt) from InfluenzaB__AGX17844__NA

SEQ ID NO: 29389 - RNA, 1401 nt, Artificial Sequence; identical to SEQ ID NO: 29382
  derived and/or modified CDS sequence (AUadapt) from InfluenzaB__AGX17855__NA

SEQ ID NO: 29390 - RNA, 1401 nt, Artificial Sequence; identical to SEQ ID NO: 29001
  derived and/or modified CDS sequence (AUadapt) from InfluenzaB__AGX17866__NA

SEQ ID NO: 29391 - RNA, 1401 nt, Artificial Sequence; identical to SEQ ID NO: 29367
  derived and/or modified CDS sequence (AUadapt) from InfluenzaB__AGX17877__NA

SEQ ID NO: 29392 - RNA, 1401 nt, Artificial Sequence; identical to SEQ ID NO: 29374
  derived and/or modified CDS sequence (AUadapt) from InfluenzaB__AGX17888__NA

SEQ ID NO: 29393 - RNA, 1401 nt, Artificial Sequence; identical to SEQ ID NO: 29367
  derived and/or modified CDS sequence (AUadapt) from InfluenzaB__AGX17899__NA

SEQ ID NO: 29394 - RNA, 1401 nt, Artificial Sequence; identical to SEQ ID NO: 29374
  derived and/or modified CDS sequence (AUadapt) from InfluenzaB__AGX17910__NA

SEQ ID NO: 29395 - RNA, 1401 nt, Artificial Sequence; identical to SEQ ID NO: 29374
  derived and/or modified CDS sequence (AUadapt) from InfluenzaB__AGX17921__NA

SEQ ID NO: 29396 - RNA, 1401 nt, Artificial Sequence; identical to SEQ ID NO: 29001
  derived and/or modified CDS sequence (AUadapt) from InfluenzaB__AGX17932__NA

SEQ ID NO: 29397 - RNA, 1401 nt, Artificial Sequence
  derived and/or modified CDS sequence (AUadapt) from InfluenzaB__AGX17943__NA
augcugcccaguaccauccagacccucacgcuguuccugaccuccggcggggugcuccugagccuguacgucuccgccagccucuccuaccugcuguauagcgacauccuccugaaguucccgcccaccgagaucaccgcccccacgaugccccuggacugcgcgaaugccuccaacgugcaggccgugaaccgcagcgccaccaagggcgucacccuccugcugccggagcccgaguggaccuacccccggcucuccugccccgggaguacguuccagaaggcccugcugaucuccccgcaccgcuucggcgagaccaaggggaacucggcgccccucaucauccgggagcccuuuaucgccugcggccccaaggagugcaagcacuucgcccugacccacuaugccgcgcagccgggcggguacuacaacggcacccgcggggaccggaacaagcugcgccaucucaucuccgugcggcugggcaagauccccacgguggagaacagcaucuuccacauggccgccugguccgggagcgccugccaugacggcaaggaguggaccuacaucggcgucgacgggcccgacaacaaugcccugcucaagaucaaguacggcgaggcguacaccgacaccuaccacuccuaugccaacaacauccugcgcacgcaggagagcgccugcaacuguaucgggggcaacugcuaccugaugaucaccgacggcuccgccagcggggugagugagugccgguuccucaagauccgcgagggccggaucaucaaggagaucuuccccaccgggcgcgugaagcacaccgaggagugcacguguggcuucgccuccaacaagaccaucgagugcgcgugccgggacaauucguacaccgccaagcgcccguucgucaagcugaacguggagaccgacacggccgagauccggcugaugugcaccgagaccuaucucgacacgccccgccccgacgacggguccaucaccggccccugcgagagcaauggcgacaagggguccggcgggaucaagggcggguucgugcaccagcggauggccagcaagaucggccgcugguacucccggaccaugaguaagaccaagcgcaugggcauggggcuguacgucaaguacgacggcgacccgugggccgacuccgaugcgcuggccuucagcggggugaugguguccauggaggagcccggcugguacagcuucggguuugagaucaaggacaagaagugcgacguccccugcaucggcaucgagauggugcacgauggcgggaaggagaccuggcacuccgccgccacggccaucuacugccucaugggcagcgggcagcugcugugggacaccgugaccggcgucaacauggcgcucuga

SEQ ID NO: 29398 - RNA, 1401 nt, Artificial Sequence; identical to SEQ ID NO: 29367
  derived and/or modified CDS sequence (AUadapt) from InfluenzaB__AGX17954__NA

SEQ ID NO: 29399 - RNA, 1401 nt, Artificial Sequence
  derived and/or modified CDS sequence (AUadapt) from InfluenzaB__AGX17976__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcacgccgugaaccgcuccgccaccaagggcgucacgccccuccugccggagcccgaguggaccuacccccggcugagcugucccggguccaccuuccagaaggcccuccugaucagcccgcaccgcuucggcgagaccaaggggaacuccgcgccccugaucauccgggagcccuucaucgccuguggccccaacgagugcaagcacuucgcccucacccacuacgccgcgcagccgggcggguauuacaacggcacccgcggggaccggaacaagcugcgccaccugaucagugugaagcucggcaagauccccacgguggagaacuccaucuuccacauggccgccuggagcggguccgccugccacgauggcaaggaguggaccuacaucggcgucgacgggcccgacaacaacgcccugcugaagaucaaguacggcgaggcguauaccgacaccuaccacucguacgccaauaacauccuccggacgcaggaguccgccugcaacugcaucgggggcaacugcuaucugaugaucaccgacggcagcgccagcgggguguccgagugccgcuuccugaagauccgggagggccgcaucaucaaggagaucuuucccaccgggcgggugaagcacaccgaggagugcacgugcggcuucgccagcaacaagaccaucgagugugcgugccgcgacaacuccuacaccgccaagcggccguucgucaagcucaacguggagaccgauacggccgagauccgccugaugugcaccgacaccuaccuggacacgccccggcccgacgaugggagcaucaccggccccugcgaguccaacggcgacaaggggucgggcgggaucaagggcggguucgugcaucagcgcauggccuccaagaucggccggugguacagccgcaccauguccaagaccgagcggaugggcauggggcucuacgucaaguacgacggcgacccgugggccgauagcgacgcgcuggccuucuccggggugauggugagcaugaaggagcccggcugguacuccuuuggguucgagaucaaggacaagaagugcgacguccccugcaucggcaucgagauggugcacgauggcgggaaggagaccuggcacagcgccgccacggccaucuacugccugaugggcuccgggcagcuccugugggacaccgugaccggcgucgacauggcgcuguga

SEQ ID NO: 29400 - RNA, 1401 nt, Artificial Sequence
  derived and/or modified CDS sequence (AUadapt) from InfluenzaB__AGX17987__NA
augcugcccaguaccauccagacccucacgcuguuccugaccuccggcggggugcuccugagccuguacgucuccgugagccucuccuaccugcuguacagugacauccuccugaaguucccgcccaccgagaucaccgcccccacgaugccccuggacugcgccaacgcguccaacgugcaggccgucaaucgcagcgccaccaagggcgugacccuccugcugccggagcccgaguggaccuacccccggcucuccugccccgggagcacguuccagaaggcccugcugaucuccccgcaccgcuuuggcgagaccaaggggaacagcgcgccccucaucauccgggagcccuucaucgccugcggccccaaggagugcaagcacuuugcccugacccacuacgccgcccagccgggcggguacuacaacggcacccgcggggaccggaacaagcugcgccaucucaucuccgugaagcugggcaagauccccacggucgagaacucgaucuuccacauggcggccugguccgggagcgccugccaugacggcaaggaguggaccuacaucggcguggacgggcccgacaacaacgcccugcucaagaucaaguauggcgaggccuacaccgacaccuaccacuccuacgcgaacaauauccugcggacgcaggagagcgccugcaacugcaucgggggcaacugcuaccugaugaucaccgauggcuccgccagcggggugucggagugccgcuuccucaagauccgggagggccgcaucaucaaggagaucuuccccaccgggcgggucaagcacaccgaggaguguacgugcggcuucgccuccaacaagaccaucgagugcgccugccgcgacaauagcuacaccgcgaagcggccguucgugaagcugaacguggagaccgacacggccgagauccgccugaugugcaccgagaccuaucucgacacgccccggcccgacgacggguccaucaccggccccugcgagagcaacggcgacaagggguccggcgggaucaagggcggguuuguccaccagcgcauggccagcaagaucggccggugguacucccgcaccaugucgaagaccaagcggaugggcauggggcuguacgugaaguacgauggcgacccgugggccgacuccgacgcccuggcguucagcggggugauggucuccauggaggagcccggcugguacaguuucggguucgagaucaaggacaagaagugcgacgugcccugcaucggcaucgagauggugcaugacggcgggaaggagaccuggcacuccgccgccacggccaucuacugccucaugggcagcgggcagcugcugugggacaccgucaccggcgugaacauggcccucuga

SEQ ID NO: 29401 - RNA, 1401 nt, Artificial Sequence; identical to SEQ ID NO: 29374
  derived and/or modified CDS sequence (AUadapt) from InfluenzaB__AGX17998__NA

SEQ ID NO: 29402 - RNA, 1401 nt, Artificial Sequence; identical to SEQ ID NO: 29367
  derived and/or modified CDS sequence (AUadapt) from InfluenzaB__AGX18009__NA

SEQ ID NO: 29403 - RNA, 1401 nt, Artificial Sequence; identical to SEQ ID NO: 29400
  derived and/or modified CDS sequence (AUadapt) from InfluenzaB__AGX18020__NA

SEQ ID NO: 29404 - RNA, 1401 nt, Artificial Sequence; identical to SEQ ID NO: 29367
  derived and/or modified CDS sequence (AUadapt) from InfluenzaB__AGX18031__NA

SEQ ID NO: 29405 - RNA, 1401 nt, Artificial Sequence
  derived and/or modified CDS sequence (AUadapt) from InfluenzaB__AGX18042__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccugaacugcgcgaacgccagcaacgugcaggccgugaaucgcuccgccaccaagggcgucacccuccugcugcccgagccggaguggaccuacccccggcucagcugccccggguccacguuccagaaggcccugcugaucagcccccaccgcuucggcgagaccaaggggaauuccgcgccgcucaucauccgggagcccuucaucgccugcggccccaacgagugcaagcacuucgcccugacccacuaugccgcgcagcccggcggguacuacaacggcacccgcggggaccggaacaagcugcgccaccucaucucggugaagcugggcaagaucccgacgguggagaauuccaucuuccacauggccgccuggagcggguccgccugccacgacggcaaggaguggaccuauaucggcgucgacgggcccgacaacaacgcccugcucaagaucaaguacggcgaggcguacaccgacaccuaucacagcuacgccaacaacauccugcggacgcaggaguccgccugcaacuguaucgggggcaacugcuaccugaugaucaccgacggcagcgccucggggguguccgagugccgcuuucucaagauccgggagggccgcaucaucaaggagaucuuccccaccgggcgggugaagcacaccgaggagugcacgugcggcuucgccagcaacaagaccaucgagugugcgugccgcgacaacuccuacaccgccaagcggcccuucgucaagcugaacguggagaucgauaccgccgagauccgccugaugugcacggacaccuaccucgacaccccgcggcccgacgacgggagcaucaccggccccugugaguccaacggcgacaaggggagcggcgggaucaagggcggguucgugcaccagcgcauggccuccaagaucggccggugguacucgcgcacgauguccaagaccgagcggaugggcauggggcuguaugucaaguacgacggcgaccccugggccgacagcgacgcgcuggccuucuccggggugauggugaguaugaaggagccgggcugguacuccuucggguucgagaucaaggacaagaagugcgacguccccugcaucggcaucgagauggugcaugacggcgggaaggagaccuggcacagcgccgccaccgccaucuacugccucaugggcuccgggcagcugcugugggacacggugaccggcgucgacauggcgcucuga

SEQ ID NO: 29406 - RNA, 1401 nt, Artificial Sequence; identical to SEQ ID NO: 29374
  derived and/or modified CDS sequence (AUadapt) from InfluenzaB__AGX18053__NA

SEQ ID NO: 29407 - RNA, 1401 nt, Artificial Sequence; identical to SEQ ID NO: 29374
  derived and/or modified CDS sequence (AUadapt) from InfluenzaB__AGX18064__NA

SEQ ID NO: 29408 - RNA, 1401 nt, Artificial Sequence
  derived and/or modified CDS sequence (AUadapt) from InfluenzaB__AGX18075__NA
augcugcccaguaccauccagacccucacgcuguuccugaccuccggcggggugcuccugagccuguacgucuccgccagccucuccuaccugcuguacagugacauccuccugaaguucccgcccaccgagaucaccgcccccacgaugccccuggacugcgcgaacgccuccaacgugcaggccgugaaucgcagcgccaccaagggcgucacccuccugcugccggagcccgaguggaccuacccccggcucuccugccccgggagcacguuccagaaggcccugcugaucuccccgcaccgcuuuggcgagaccaaggggaacagcgcgccccucaucauccgggagcccuucaucgccugcggccccaaggagugcaagcacuuugcccugacccacuacgccgcgcagccgggcggguacuacaacggcacccgcggggaccggaacaagcugcgccaucucaucuccgugaagcugggcaagauccccacgguggagaacucgaucuuccacauggccgccugguccgggagcuccugccaugacggcaaggaguggaccuacaucggcgucgacgggcccgacaacaacgcccugcucaagaucaaguauggcgaggccuacaccgacaccuaccacagcuacgcgaauaacauccugcggacgcaggaguccgccugcaacugcaucgggggcaacugcuaccugaugaucaccgauggcagcgccucggggguguccgagugccgcuuccucaagauccgggagggccgcaucaucaaggagaucuuccccaccgggcgggugaagcacaccgaggaguguacgugcggcuucgccagcaacaagaccaucgagugcgccugccgcgauaacuccuacaccgcgaagcggccguucgucaagcugaacguggagaccgacacggccgagauccgccugaugugcaccgagaccuaucucgacacgccccggcccgacgacgggagcaucaccggccccugcgaguccaacggcgacaaggggaguggcgggaucaagggcggguucgugcaccagcgcauggccuccaagaucggccggugguacucgcgcaccauguccaagaccaagcggaugggcauggggcuguacgucaaguacgauggcgacccgugggccgacagcgacgcccuggcguucuccggggugauggugagcauggaggagcccggcugguauuccuucggguucgagaucaaggacaagaagugcgacguccccugcaucggcaucgagauggugcaugacggcgggaaggagaccuggcacagcgccgccacggccaucuacugccucaugggcuccgggcagcugcugugggacaccgugaccggcgucaacauggcccucuga

SEQ ID NO: 29409 - RNA, 1401 nt, Artificial Sequence; identical to SEQ ID NO: 29001
  derived and/or modified CDS sequence (AUadapt) from InfluenzaB__AGX18086__NA

SEQ ID NO: 29410 - RNA, 1401 nt, Artificial Sequence; identical to SEQ ID NO: 29001
  derived and/or modified CDS sequence (AUadapt) from InfluenzaB__AGX18097__NA

SEQ ID NO: 29411 - RNA, 1401 nt, Artificial Sequence; identical to SEQ ID NO: 28954
  derived and/or modified CDS sequence (AUadapt) from InfluenzaB__AGX18108__NA

SEQ ID NO: 29412 - RNA, 1401 nt, Artificial Sequence
  derived and/or modified CDS sequence (AUadapt) from InfluenzaB__AGX18119__NA
augcugcccaguaccauccagacccucacgcuguuccugaccuccggcggggugcuccugagccuguacgucuccgccucgcucuccuaccugcuguacagcgauauccuccugaaguucuccccgaccgagaucaccgcccccacgaugccccuggacugcgcgaacaccucgaacgugcaggccgugaaccgcuccgccaccaagggcgucacccuccugcugcccgagccggaguggacguacccccggcucaguugccccggguccaccuuccagaaggcccugcugaucagcccccaccgcuucggcgagaccaaggggaacuccgccccgcucaucauccgggagcccuucaucgcgugcggccccaaugagugcaagcacuucgcccugacccacuacgccgcccagcccggcggguacuacaacggcacgcgcggggaucggaacaagcugcgccaccucaucucggugaagcugggcaagaucccgaccguggagaacuccaucuuccacauggcggccuggagcggguccgccugccaugacggcaaggaguggaccuacaucggcgucgacgggcccgacaacaacgcccugcucaagaucaaguacggcgaggccuacaccgauacguaccacucguacgcgaacaacauccugcggacccaggaguccgccugcaacuguaucgggggcaacugcuaccugaugaucaccgacggcagcgccucggggguguccgagugccgcuuccucaagauccgggagggccgcaucaucaaggagaucuuucccaccgggcgggugaagcacacggaggagugcacgugcggcuucgccagcaacaagaccaucgagugcgccugccgcgauaacuccuacaccgcgaagcggcccuucgucaagcugaacauggagaccgacaccgccgagaucaagcugaugugcaccgacaccuaccucgauacgccgcgccccgacgacgggagcaucaccggccccugcgaguccaacggcgacaaggggucgggcgggaucaagggcggguucgugcaucagcggauggccuccaagaucggccgcugguacagccggaccauguccaagaccgagcgcaugggcauggggcuguacgugaaguacgacggcgaccccugggccgacucggaugcccuggcguucuccggggucauggugagcaugaaggagccgggcugguacuccuucggguucgagaucaaggacaagaagugcgacgugcccuguaucggcaucgagaugguccacgacggcgggaaggagacguggcacagcgccgccaccgccaucuacugccucaugggcuccgggcagcugcugugggacaccgugaccggcguggacauggcccucuga

SEQ ID NO: 29413 - RNA, 1401 nt, Artificial Sequence
  derived and/or modified CDS sequence (AUadapt) from InfluenzaB__AGX18130__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuucagaaggcccugcugaucagcccccaccgcuucggcgagaccaaggggaacuccgcgccgcucaucauccgggagcccuucaucgccugcggccccaaugagugcaagcacuucgcccugacccacuacgccgcgcagcccggcggguauuacaacggcacccgcggggaccggaacaagcugcgccaccucaucagcgugaagcugggcaagaucccgacgguggagaauuccaucuuccacauggccgccuggagcggguccgccugccacgacggcaaggaguggaccuauaucggcgucgacgggcccgacaacaacgcccugcucaagaucaaguacggcgaggcguauaccgacaccuaccacucguacgccaacaauauccugcggacgcaggaguccgccugcaacugcaucgggggcaacugcuaucugaugaucaccgacggcagcgccagcgggguguccgagugccgcuuccucaagauccgggagggccgcaucaucaaggagaucuuccccaccgggcgggugaagcauaccgaggagugcacgugcggcuucgccagcaacaagaccaucgagugugcgugccgcgacaacuccuacaccgccaagcggcccuucgucaagcugaacguggagaucgauaccgccgagauccgccugaugugcacggacaccuaccucgacaccccgcggcccgacgacgggaguaucaccggccccugcgaguccaacggcgacaaggggagcggcgggaucaagggcggguucgugcaucagcgcauggccuccaagaucggccggugguacagccgcacgaugucccggaccgagcgcaugggcauggggcuguacgucaaguacgacggcgaccccugggccgauagcgacgcgcuggccuucuccggggugauggugagcaugaaggagccgggcugguacuccuuuggguucgagaucaaggacaagaagugcgacguccccugcaucggcaucgagauggugcacgauggcgggaaggagaccuggcacagcgccgccaccgccaucuacugccucaugggcuccgggcagcugcugugggacacggugaccggcgucgacauggcgcucuga

SEQ ID NO: 29414 - RNA, 1401 nt, Artificial Sequence
  derived and/or modified CDS sequence (AUadapt) from InfluenzaB__AGX18141__NA
augcugcccaguaccauccagacccucacgcuguuccugaccuccggcggggugcuccugagccuguacgucuccgccagccucuccuaccugcuguacagugacauccuccugaaguucccguccaccgagaucaccgcccccacgaugccccuggacugcgcgaacgccagcaacgugcaggccgugaaucgcuccgccaccaagggcaugacccuccugcugcccgagccggaguggaccuacccccggcucagcugccccggguccacguuccagaaggcccugcugaucucgccccaccgcuuuggcgagaccaaggggaacuccgcgccgcucaucauccgggagcccuucaucgccugcggccccaaggagugcaagcacuucgcccugacccacuaugccgcgcagcccggcggguacuacaacggcacccgcggggaccggaacaagcugcgccaccucaucagcgucaagcugggcaagaucccgacgguggagaauuccaucuuccacauggccgccuggagcggguccgccugccacgacggcaaggaguggaccuauaucggcguggacgggcccgacaacaacgcccugcucaagaucaaguacggcgaggcguacaccgacaccuaucacucguacgccaacaacauccugcggacgcaggaguccgccugcaacuguaucgggggcaacugcuaccugaugaucaccgacggcagcgccagcggggucuccgagugucgcuuccucaagauccgggagggccgcaucaucaaggagaucuuccccaccgggcggaucaagcacaccgaggagugcacgugcggcuucgccucgaauaagaccaucgagugcgcgugccgcgacaacuccuacaccgccaagcggcccuucgugaagcugaauguggagaccgacacggccgagauccgccugaugugcaccgagaccuaccucgacaccccgcggcccgacgacgggagcaucacgggccccugugaguccaacggcgacaaggggagcggcgggaucaagggcggguucguccaccagcgcauggccuccaagaucggccggugguacucgcgcaccauguccaagaccgagcggaugggcauggggcuguaugugaaguacgacggcgaccccugggccgagagcgacgcgcuggccuucuccggggugauggucaguauggaggagccgggcugguacuccuucggguucgagaucaaggacaagaagugcgacgugcccugcaucggcaucgagauggugcaugacggcgggaaggagaccuggcacagcgccgccacggccaucuacugccucaugggcuccgggcagcugcugugggacaccgucaccggcgugaacauggcgcucuga

SEQ ID NO: 29415 - RNA, 1401 nt, Artificial Sequence; identical to SEQ ID NO: 29001
  derived and/or modified CDS sequence (AUadapt) from InfluenzaB__AGX18152__NA

SEQ ID NO: 29416 - RNA, 1401 nt, Artificial Sequence
  derived and/or modified CDS sequence (AUadapt) from InfluenzaB__AGX18163__NA
augcugcccaguaccauccagacccucacgcuguuccugaccuccggcggggugcuccugagccuguacgucuccgccagccucuccuaccugcuguacagugacauccuccugaaguucccguccaccgagaucaccgcccccacgaugccccuggacugcgcgaacgccagcaacgugcaggccgugaaucgcuccgccaccaagggcgucacccuccugcugcccgagccggaguggaccuacccccggcucagcugccccggguccacguuccagaaggcccugcugaucucgccccaccgcuucggcgagaccaaggggaauuccgcgccgcucaucauccgggagcccuucaucgccugcggccccaaggagugcaagcacuucgcccugacccacuaugccgcgcagcccggcggguacuacaacggcaagcgcggggaccggaacaagcugcgccaccucaucagcgugaagcugggcaagaucccgaccguggagaauuccaucuuccacauggccgccuggagcggguccgccugccacgacggcaaggaguggacguacaucggcgucgaugggcccgacaacaacgcccugcucaagaucaaguacggcgaggcguacaccgacaccuaucacucguacgccaacaacauccugcggacccaggaguccgccugcaacuguaucgggggcaacugcuaccugaugaucacggacggcagcgccagcgggguguccgagugccgcuuucucaagauccgggagggccgcaucaucaaggagaucuuccccaccgggcggaucaagcacaccgaggagugcacgugcggcuucgccucgaauaagaccaucgagugcgcgugccgcgacaacuccuacaccgccaagcggcccuucgugaagcugaacgucgagaccgauaccgccgagauccgccugaugugcacggagaccuaccucgacaccccgcggcccgacgacgggagcaucaccggccccugcgaguccaauggcgacaaggggagcggcgggaucaagggcggguucgugcaccagcgcauggccuccaagaucggccggugguacucgcgcacgauguccaagaccgagcggaugggcauggggcuguaugugaaguacgacggcgaccccugggccgacagcgacgcgcuggccuucuccggggucauggugaguauggaggagccgggcugguacuccuucggguucgagaucaaggacaagaagugcgacgugcccugcaucggcaucgagaugguccaugacggcgggaaggagaccuggcacagcgccgccaccgccaucuacugccucaugggcuccgggcagcugcugugggacacggugaccggcgugaacauggcgcucuga

SEQ ID NO: 29417 - RNA, 1401 nt, Artificial Sequence; identical to SEQ ID NO: 29367
  derived and/or modified CDS sequence (AUadapt) from InfluenzaB__AGX18174__NA

SEQ ID NO: 29418 - RNA, 1401 nt, Artificial Sequence; identical to SEQ ID NO: 29001
  derived and/or modified CDS sequence (AUadapt) from InfluenzaB__AGX18185__NA

SEQ ID NO: 29419 - RNA, 1401 nt, Artificial Sequence; identical to SEQ ID NO: 28954
  derived and/or modified CDS sequence (AUadapt) from InfluenzaB__AGX18196__NA

SEQ ID NO: 29420 - RNA, 1401 nt, Artificial Sequence
  derived and/or modified CDS sequence (AUadapt) from InfluenzaB__AGX18207__NA
augcugcccaguaccauccagacccucacgcuguuccugaccuccggcggggugcuccugagccuguacgucuccgccagccucuccuaccugcuguauagcgacauccuccugaaguucccgcccaccgagaucaccgcccccacgaugccccuggacugcgcgaaugccuccaacgugcaggccgugaaccgcucggccaccaagggcgucacccuccugcugccggagcccgaguggaccuacccccggcucuccugccccgggagcacguuucagaaggcccugcugaucuccccgcaccgcuucggcgagaccaaggggaacagcgcgccccucaucauccgggagcccuucaucgccuguggccccaaggagugcaagcacuucgcccugacccacuacgccgcgcagccgggcggguacuauaacggcacccgcggggaccggaacaagcugcgccaccucaucuccgugaagcugggcaagauccccacgguggagaccagcaucuuucacauggccgccugguccgggagcgccugccacgacggcaaggaguggaccuauaucggcgucgacgggcccgacaacaacgcccugcucaagaucaaguacggcgaggcguacaccgauacguaccacuccuacgccaacaacauccugcggacccaggagagugccugcaacugcaucgggggcaacugcuaccugaugaucaccgauggcuccgccagcggggugagcgagugccgcuuccucaagauccgggagggccgcaucaucaaggagaucuuccccaccgggcgggugaagcauacggaggagugcacgugcggcuucgccuccaacaagaccaucgagugcgcgugccgcgauaacagcuacaccgccaagcggccguucgucaagcugaacguggagaccgauaccgccgagauccgccugaugugcaccgagaccuaccucgacacgccccggcccgacgacggguccaucaccggccccugugagagcaacggcgacaagggguccggcgggaucaagggcggguucgugcaccagcgcauggccucgaagaucggccggugguauucccgcaccaugagcaagaccaagcggaugggcauggggcuguacgucaaguacgacggcgacccgugggccgauuccgacgcgcuggccuucagcggggugaugguguccauggaggagcccggcugguacagcuucggguuugagaucaaggacaagaagugcgacguccccugcaucggcaucgagauggugcacgauggcgggaaggagacguggcacuccgccgccaccgccaucuacugccucaugggcagcgggcagcugcugugggacaccgugaccggcgucaacauggcgcucuga

SEQ ID NO: 29421 - RNA, 1401 nt, Artificial Sequence
  derived and/or modified CDS sequence (AUadapt) from InfluenzaB__AGX18218__NA
augcugcccaguaccauccagacccucacgcuguuccugaccuccggcggggugcuccugagccuguacgucuccgccagccucuccuaccugcuguacagugacauccuccugaagcuguccccgaccgagaucaccgcccccacgaugccccucgacugcgcgaacaccagcaacgugcaggccgugaaucgcuccgccaccaagggcgucacccugcugcuccccgagccggaguggacguacccccggcugagcugccccggguccaccuuccagaaggcccugcucaucucgccccaccgcuuuggcgagaccaaggggaacuccgccccgcugaucauccgggagcccuucaucgcgugcggccccaacgagugcaagcacuucgcccugacccauuacgccgcccagcccggcggguacuacaaccgcacgcggggcgaccgcaacaagcuccggcaucugaucagcgugaagcuggggaagaucccgaccguggagaacuccaucuuccacauggcggccuggagcggcuccgccugccaugacgggaaggaguggaccuacaucggcgucgacggccccgacaacaacgcccuccugaagaucaaguacggggaggccuauaccgacacguaccacucguacgcgaacaauauccugcgcacccaggaguccgccugcaacugcaucggcgggaacugcuaccucaugaucaccgauggcagcgccagcggcguguccgagugccgguuccugaagauccgcgaggggcggaucaucaaggagaucuuccccaccggccgcgugaagcacacggaggaguguacgugcggguucgccucgaacaagaccaucgagugcgccugccgggacaauuccuacaccgcgaagcgccccuucgucaagcugaacauggagaccgacaccgccgagauccggcucaugugcaccgacaccuaucuggacacgccgcgccccgacgacggcagcaucaccgggcccugcgaguccaacggcgauaagggcagcgggggcaucaagggcggguucgugcaccagcggauggccuccaagaucgggcgcugguacucgcggaccauguccaagaccgagcgcaugggcaugggccuguacgugaaguacgauggggaccccugggccgacagcgacgcccucgcguucuccggcgucauggugagcaugaaggagccggggugguauuccuucggcuucgagaucaaggacaagaagugcgacgugcccugcaucgggaucgagaugguccaugacggcggcaaggagacguggcacagcgccgccaccgccaucuacugccugaugggguccggccagcugcucugggacaccgugaccgggguggacauggcccuguga

SEQ ID NO: 29422 - RNA, 1401 nt, Artificial Sequence; identical to SEQ ID NO: 29374
  derived and/or modified CDS sequence (AUadapt) from InfluenzaB__AGX18229__NA

SEQ ID NO: 29423 - RNA, 1401 nt, Artificial Sequence
  derived and/or modified CDS sequence (AUadapt) from InfluenzaB__AGX18240__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaacgugcagaccgugaaucgcuccgccaccaagggcgucacccuccugcugcccgagccggaguggacguacccccggcucagcugccccggguccaccuuccagaaggcccugcugaucagcccccaccgcuucggcgagaccaaggggaauuccgccccgcucaucauccgggagcccuucaucgcgugcggccccaacgagugcaagcacuucgcccugacccacuaugccgcccagcccggcggguacuacaacggcacgcgcggggaccggaacaagcugcgccaccucaucucggugaagcugggcaagaucccgaccguggagaauuccaucuuccacauggcggccuggagcggguccgccugccacgacggcaaggaguggaccuauaucggcgucgacgggcccgacaacaacgcccugcucaagaucaaguacggcgaggccuacaccgacacguaucacagcuacgcgaacaacauccugcggacccaggaguccgccugcaacuguaucgggggcaacugcuaccugaugaucaccgacggcagcgccucggggguguccgagugccgcuuucucaagauccgggagggccgcaucaucaaggagaucuuccccaccgggcgggugaagcacacggaggagugcacgugcggcuucgccagcaacaagaccaucgagugugccugccgcgacaacuccuacaccgcgaagcggcccuucgucaagcugaacguggagaucgauaccgccgagauccgccugaugugcaccgacaccuaccucgacaccccgcggcccgacgacgggagcaucacgggccccugugaguccaacggcgacaaggggagcggcgggaucaagggcggguucgugcaccagcgcauggccuccaagaucggccggugguacucgcgcaccauguccaagaccgagcggaugggcauggggcuguaugucaaguacgacggcgaccccugggccgacagcgacgcccuggcguucuccggggugauggugaguaugaaggagccgggcugguacuccuucggguucgagaucaaggacaagaagugcgacguccccugcaucggcaucgagauggugcaugacggcgggaaggagaccuggcacagcgccgccacggccaucuacugccucaugggcuccgggcagcugcugugggacaccgugaccggcgucgacauggcccucuga

SEQ ID NO: 29424 - RNA, 1401 nt, Artificial Sequence; identical to SEQ ID NO: 29367
  derived and/or modified CDS sequence (AUadapt) from InfluenzaB__AGX18251__NA

SEQ ID NO: 29425 - RNA, 1401 nt, Artificial Sequence
  derived and/or modified CDS sequence (AUadapt) from InfluenzaB__AGX18262__NA
augcugcccaguaccauccagacccucacgcuguuccugaccuccggcggggugcuccugagccuguacgucuccgccagccucuccuaccugcuguauagcaacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaacgaguguaagcacuucgcccugacccacuacgccgcgcagcccggcggguacuacaauggcacccgcggggaccggaacaagcugcgccaccucaucagcgugaagcugggcaagaucccgacgguggagaacuccaucuuccauauggccgccuggagcggguccgccugccacgacggcaaggaguggaccuacaucggcgucgacgggcccgauaacaacgcccugcucaagaucaaguacggcgaggcguacaccgacaccuaccauucguacgccaacaacauccugcggacgcaggaguccgccugcaacuguaucgggggcaacugcuaccugaugaucaccgacggcagcgccagcgggguguccgagugucgcuuccucaagauccgggagggccgcaucaucaaggagaucuuccccaccgggcgggugaagcacaccgaggagugcacgugcggcuucgccaguaacaagaccaucgagugcgcgugccgcgacaacuccuacaccgccaagcggcccuuugucaagcugaacguggagaccgacacggccgagauccgccugaugugcaccgacaccuaccucgacaccccgcggcccgaugacgggagcaucacgggccccugcgaguccaacggcgacaaggggucgggcgggaucaagggcggguuugugcaccagcgcauggccuccaaggucggccggugguacagccgcaccauguccaagaccgagcggaugggcauggggcuguacgugaaguacgacggcgaucccugggccgacagcgacgcgcuggccuucuccggggugauggucagcaugaaggagccgggcugguacuccuuuggguucgagaucaaggacaagaagugcgacgugcccugcaucggcaucgagauggugcacgauggcgggaaggagaccuggcacagcgccgccacggccaucuacugccucaugggcuccgggcagcugcugugggacaccgucaccggcguggacauggcgcucuga

SEQ ID NO: 29426 - RNA, 1401 nt, Artificial Sequence; identical to SEQ ID NO: 29374
  derived and/or modified CDS sequence (AUadapt) from InfluenzaB__AGX18273__NA

SEQ ID NO: 29427 - RNA, 1401 nt, Artificial Sequence; identical to SEQ ID NO: 29399
  derived and/or modified CDS sequence (AUadapt) from InfluenzaB__AGX18284__NA

SEQ ID NO: 29428 - RNA, 1401 nt, Artificial Sequence; identical to SEQ ID NO: 29374
  derived and/or modified CDS sequence (AUadapt) from InfluenzaB__AGX18295__NA

SEQ ID NO: 29429 - RNA, 1401 nt, Artificial Sequence; identical to SEQ ID NO: 29001
  derived and/or modified CDS sequence (AUadapt) from InfluenzaB__AGX18306__NA

SEQ ID NO: 29430 - RNA, 1401 nt, Artificial Sequence
  derived and/or modified CDS sequence (AUadapt) from InfluenzaB__AGX18317__NA
augcugcccaguaccauccagacccucacgcuguuccugaccuccggcggggugcuccugagccuguacgucuccgccucgcucuccuaccugcuguacagcgauauccuccugaaguucccguccaccgagaucaccgcccccacgaugccccuggacugcgcgaacgccagcaacgugcaggccgugaaccgcuccgccaccaagggcgucacccuccugcugcccgagccggaguggaccuauccccggcucucgugccccggguccacguuccagaaggcccugcugaucagcccccaccgcuucggcgagaccaaggggaacuccgcgccgcucaucauccgggagcccuuuaucgccugcggccccaaggagugcaagcacuucgcccugacccacuacgccgcgcagcccggcggguacuauaacgagacccgcggcgaccggaacaagcugcgccaccucaucagcgugaagcuggggaagaucccgacgguggagaacuccaucuuccacauggccgccuggaguggcuccgccugccacgacgggaaggaguggaccuacaucggcgucgacggccccgacaacaaugcccugcucaagaucaaguacggggaggcguacaccgacaccuaccacagcuacgccaauaacauccugcggacgcaggaguccgccugcaacugcaucggcgggaacugcuaccugaugaucaccgauggcucggccagcggcguguccgagugccgcuuccucaagauccgggaggggcgcaucaucaaggagaucuuccccaccggccggaucaagcacaccgaggagugcacguguggguucgccagcaacaagaccaucgagugcgcgugccgcgacaacuccuacaccgccaagcggcccuuugugaagcugaacgucgagaccgacacggccgagauccgccugaugugcaccgagaccuaccucgacaccccgcggcccgacgacggcaguaucacggggcccugcgaguccaacggcgacaagggcagcgggggcaucaagggcggguucgugcaccagcgcauggccuccaagaucgggcggugguacagucgcaccauguccaagaccaagcggaugggcaugggccuguacgugaaguacgacggggaccccugggccgacucggacgcgcuggccuuuuccggcgucauggugagcauggaggagccggggugguacuccuucggcuucgagaucaaggacaagaagugcgacgugcccuguaucgggaucgagaugguccacgacggcggcaaggagaccuggcacagcgccgccacggccaucuacugccucaugggguccggccagcugcugugggacaccgugaccggggugaacauggcgcucuga

SEQ ID NO: 29431 - RNA, 1401 nt, Artificial Sequence; identical to SEQ ID NO: 29374
  derived and/or modified CDS sequence (AUadapt) from InfluenzaB__AGX18328__NA

SEQ ID NO: 29432 - RNA, 1401 nt, Artificial Sequence
  derived and/or modified CDS sequence (AUadapt) from InfluenzaB__AGX18339__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccagcaacgugcaggccgugaaccgcuccgccaccaagggcgucacccuccugcugcccgagccggaguggaccuacccccggcucagcugucccggguccacguuccagaaggcccugcugaucucgccccaccgcuucggcgagaccaaggggaacuccgcgccgcucaucauccgggagcccuucaucgccuguggccccaacgagugcaagcacuucgcccugacccacuaugccgcgcagcccggcggguacuacaacggcacccgcggggaccggaacaagcugcgccaucucaucagcgugaagcugggcaagaucccgacgguggagaacuccaucuuccacauggccgccuggagcggguccgccugucacgacggcaaggaguggaccuacaucggcgucgacgggcccgacaacaaugcccugcucaagaucaaguacggcgaggcguacaccgacaccuaccacaguuacgccaacaacauccugcggacgcaggaguccgccugcaacuguaucgggggcaacugcuaccugaugaucaccgacggcagcgccagugggguguccgagugccgcuuccucaagauccgggagggccgcaucaucaaggagaucuuccccaccgggcgggugaagcacaccgaggagugcacgugcggcuuugccucgaacaagaccaucgagugcgcgugccgcgacaauuccuacaccgccaagcggcccuucgucaagcugaacguggagaccgacacggccgagauccgccugaugugcaccgauaccuaccucgacaccccgcggcccgacgacgggagcaucacgggccccugugaguccaacggcgacaaggggagcggcgggaucaagggcggguucgugcaccagcgcauggccuccaaggucggccggugguacagucgcaccauguccaagaccgagcggaugggcauggggcuguacgugaaguacgacggcgaccccugggccgacagugacgcgcuggccuucgggggcgugauggucuccaugaaggagccggggugguacagcuucggcuuugagaucaaggacaagaagugcgacgugcccugcaucggcaucgagauggugcacgaugggggcaaggagaccuggcacuccgccgccacggccaucuacugccucauggggagcggccagcugcugugggacaccgucaccggcguggacauggcgcucuga

SEQ ID NO: 29433 - RNA, 1401 nt, Artificial Sequence
  derived and/or modified CDS sequence (AUadapt) from InfluenzaB__AGX18350__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaacgugcaggccaugaaucgcuccgccaccaagggcgugacccuccugcugcccgagccggaguggaccuacccccggcucagcugccccggguccacguuccagaaggcccugcugaucagcccccaccgcuucggcgagaccaaggggaauuccgcgccgcucaucauccgggagcccuucaucgccugcggccccaacgagugcaagcacuucgcccugacccacuaugccgcgcagcccggcggguacuacaacggcacccgcggggaccggaacaagcugcgccaccucaucucggucaagcugggcaagaucccgacgguggagaauuccaucuuccacauggccgccuggagcggguccgccugccacgacggcaaggaguggaccuauaucggcguggacgggcccgacaacaacgcccugcucaagaucaaguacggcgaggcguacaccgacaccuaucacagcuacgccaacaacauccugcggacgcaggaguccgccugcaacuguaucgggggcaacugcuaccugaugaucaccgacggcagcgccucgggggucuccgagugccgcuuucucaagauccgggagggccgcaucaucaaggagaucuuccccaccgggcgggugaagcacaccgaggagugcacgugcggcuucgccagcaacaagaccaucgagugugcgugccgcgacaacuccuacaccgccaagcggcccuucgugaagcugaacgucgagaucgauaccgccgagauccgccugaugugcacggacaccuaccucgacaccccgcggcccgacgacgggagcaucaccggccccugugaguccaacggcgacaaggggagcggcgggaucaagggcggguucgugcaccagcgcauggccuccaagaucggccggugguacucgcgcacgauguccaagaccgagcggaugggcauggggcuguaugugaaguacgacggcgaccccugggccgacagcgacgcgcuggccuucuccggggucauggugaguaugaaggagccgggcugguacuccuucggguucgagaucaaggacaagaagugcgacgugcccugcaucggcaucgagaugguccaugacggcgggaaggagaccuggcacagcgccgccaccgccaucuacugccucaugggcuccgggcagcugcugugggacacggugaccggcguggacauggcgcucuga

SEQ ID NO: 29434 - RNA, 1401 nt, Artificial Sequence; identical to SEQ ID NO: 29399
  derived and/or modified CDS sequence (AUadapt) from InfluenzaB__AGX18361__NA

SEQ ID NO: 29435 - RNA, 1401 nt, Artificial Sequence
  derived and/or modified CDS sequence (AUadapt) from InfluenzaB__AGX18383__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacaccagcaacgugcaggccgugaaucgcuccgccaccaagggcgucacccuccugcugcccgagccggaguggacguacccccggcucagcugccccggguccaccuuccagaaggcccugcugaucagcccccaccgcuucggcgagaccaaggggaauuccgccccgcucaucauccgggagcccuucaucgcgugcggccccaacgagugcaagcacuucgcccugacccacuaugccgcccagcccggcggguacuacaacggcacgcgcggggaccggaacaagcugcgccaccucaucagugugaagcugggcaagaucccgaccguggagaacuccaucuuccacauggcggccuggagcggguccgccugccacgacggcaaggaguggaccuauaucggcgucgacgggcccgacaacaacgcccugcucaagaucaaguacggcgaggccuacaccgacacguaucacagcuacgcgaacaacauccugcggacccaggaguccgccugcaacuguaucgggggcaacugcuaccugaugaucaccgacggcagcgccucggggguguccgagugucgcuuccucaagauccgggagggccgcaucaucaaggagaucuuccccaccgggcgggugaagcacacggaggagugcacgugcggcuucgccagcaauaagaccaucgagugcgccugccgcgacaacuccuacaccgcgaagcggcccuucgucaagcugaacauggagaccgauaccgccgagauccgccugaugugcaccgacaccuaccucgacacgccgcggcccgacgacgggagcaucaccggccccugugaguccaacggcgacaaggggagcggcgggaucaagggcggguucgugcaccagcgcauggccuccaagaucggccggugguacagucgcaccauguccaagaccgagcggaugggcauggggcuguacgugaaguacgacggcgaccccugggccgacagcgacgcccuggucuuuuccggggugauggugagcaugaaggagccgggcugguacuccuucggguucgagaucaaggacaagaagugcgacguccccuguaucggcaucgagauggugcacggcgggggcaaggagacguggcacagcgcggccaccgccaucuacugccucaugggguccggccagcugcugugggacaccgugaccggcgucgacauggcccucuga

SEQ ID NO: 29436 - RNA, 1401 nt, Artificial Sequence; identical to SEQ ID NO: 29001
  derived and/or modified CDS sequence (AUadapt) from InfluenzaB__AGX18394__NA

SEQ ID NO: 29437 - RNA, 1401 nt, Artificial Sequence
  derived and/or modified CDS sequence (AUadapt) from InfluenzaB__AGX18405__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccucgaaugugcacgccgugaaccgcuccgccaccaagggcgucacgccccuccugccggagcccgaguggaccuacccccggcugagcugccccggguccaccuuccagaaggcccuccugaucaguccgcaccgcuucggcgagaccaaggggaacuccgcgccccugaucauccgggagcccuucaucgccugcggccccaacgaguguaagcacuucgcccucacccacuacgccgcgcagccgggcggguacuacaauggcacccgcggggaccggaacaagcugcgccaccugaucagcgugaagcucggcaagauccccacgguggagaacuccaucuuccauauggccgccuggagcggguccgccugccacgacggcaaggaguggaccuacaucggcgucgacgggcccgauaacaacgcccugcugaagaucaaguacggcgaggcguacaccgacaccuaccauucguacgccaacaacauccuccggacgcaggaguccgccugcaacuguaucgggggcaacugcuaccugaugaucaccgacggcagcgccagcgggguguccgagugucgcuuccugaagauccgggagggccgcaucaucaaggagaucuuccccaccgggcgggugaagcacaccgaggagugcacgugcggcuucgccaguaacaagaccaucgagugcgucugccgcgacaacuccuacaccgcgaagcggccguuugugaagcucaacguggagaccgacacggccgagauccgccugaugugcaccgacaccuaccuggacacgccccggcccgaugacgggagcaucaccggccccugcgaguccaacggcgacaaggggucgggcgggaucaagggcggguuuguccaccagcgcauggccuccaagaucggccggugguacagccgcaccauguccaagaccgagcggaugggcauggggcucuacgugaaguacgacggcgauccgugggccgacagcgacgcccuggcguucuccggggugauggucagcaugaaggagcccggcugguacuccuuuggguucgagaucaaggacaagaagugcgacgugcccugcaucggcaucgagauggugcacgauggcgggaaggagaccuggcacagcgccgccacggccaucuacugccugaugggcuccgggcagcuccugugggacaccgucaccggcguggacauggcccuguga

SEQ ID NO: 29438 - RNA, 1401 nt, Artificial Sequence
  derived and/or modified CDS sequence (AUadapt) from InfluenzaB__AGX18416__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccucgaacgugcaggccgugaaucgcuccgccaccaagggcgucacccuccugcugcccgagccggaguggaccuacccccggcucagcugccccggguccacguuccagaaggcccugcugaucagcccccaccgcuucggcgagaccaaggggaauuccgcgccgcucaucauccgggagcccuucaucgccugcggccccaacgagugcaagcacuucgcccugacccacuaugccgcgcagcccggcggguacuacaacggcacccgcggggaccggaacaagcugcgccaccucaucagcgugaagcugggcaagaucccgacgguggagaauuccaucuuccacauggccgccuggucgggguccgccugccacgacggcaaggaguggaccuacaucggcgucgaugggcccgacaacaacgcccugcucaagaucaaguacggcgaggcguacaccgacaccuaccauagcuacgccaacaacauccugcggacgcaggaguccgccugcaacugcaucgggggcaauugcuaccugaugaucaccgacggcagcgccagcgggguguccgagugccgcuuucucaagauccgggagggccgcaucaucaaggagaucuuccccaccgggcgggugaagcacaccgaggagugcacgugcggcuucgccucgaacaagaccaucgagugugcgugccgcgacaacuccuacaccgccaagcggcccuucgucaagcugaacguggagaucgacaccgccgagauccgccugauguguacggacaccuaccucgacaccccgcggcccgacgacgggagcaucaccggcuccugcgagaguaacggcgacaagggguccggcgggaucaagggcggguucgugcaccagcgcauggccagcaagaucggccggugguacucccgcacgaugucgaagaccgagcggaugggcauggggcuguaugucaaguacgacggcgaccccugggccgacuccgacgcgcuggccuucagcggggugaugguguccaugaaggagcccggcugguauagcuucggguucgagaucaaggacaagaagugcgacgucccgugcaucggcaucgagauggugcaugacggcgggaaggagaccuggcacuccgccgccaccgccaucuacugccucaugggcagcgggcagcugcugugggacacggugaccggcgucgacauggcgcucuga

SEQ ID NO: 29439 - RNA, 1401 nt, Artificial Sequence
  derived and/or modified CDS sequence (AUadapt) from InfluenzaB__AGX18428__NA
augcugcccaguaccauccagacccucacgcuguuccugaccuccggcggggugcuccugagccuguacgucuccgccucgcucuccuaccugcuguacagcgauauccuccugaaguucuccaccaccgagaucacggccccgaccaugccccuggacugcgcgaacgccagcaacgugcaggccgugaaccgcuccgccaccaagggcgucacccuccugcugcccgagcccgaguggacguacccgcggcucaguugccccggguccaccuuccagaaggcccugcugaucagcccccaccgcuucggcgagaccaaggggaacuccgcgccccucaucauccgggagccguucaucgccugcggccccaaggaguguaagcacuucgcccugacccacuacgccgcgcagcccggcggguacuacaacggcacgcgcgaggaucggaacaagcugcgccaccucaucucggugaagcuggggaagauccccaccguggagaacuccaucuuccacauggccgccuggagcggcuccgccugccaugacgggaaggaguggaccuacaucggcgucgacggcccggacagcaacgcccugcucaagaucaaguacggggaggcguacaccgauacguaccacuccuacgccaacaacauccugcggacccaggagucggccugcaauugcaucggcgggaacugcuaccugaugaucaccgacggcagcgccuccggcaucucggagugccgcuuucucaagauccgggaggggcgcaucaucaaggagaucuuccccaccggccgggugaagcacacggaggagugcacgugcggguucgccuccaacaagaccaucgagugcgcgugccgcgauaacagcuacaccgccaagcggcccuucgugaagcugaacgucgagaccgacaccgccgagauccgccugaugugcaccgagaccuaccucgauacgccccggccggacgacggcuccaucaccgggcccugcgagagcaacggcaacaagggcuccgggggcaucaagggcggguucgugcaucagcgcauggccucgaagaucgggcggugguacucccgcaccaugagcaagaccaagcggaugggcaugggccuguacgugaaguacgacggggaccccuggaucgacuccgaugcccuggcgcucucgggcgucaugguguccauggaggagcccgggugguacagcuucggcuucgagaucaaggacaagaagugcgacgugccguguaucgggaucgagaugguccacgacggcggcaaggagacguggcacuccgccgccaccgccaucuacugccugauggggagcggccagcugcucugggacaccgugaccgggguggacauggcccuguga

SEQ ID NO: 29440 - RNA, 1401 nt, Artificial Sequence
  derived and/or modified CDS sequence (AUadapt) from InfluenzaB__AGX18439__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccucgaaugugcaggccgugaaccgcuccgccaccaagggcgucacccuccugcugcccgagccggaguggaccuacccccggcucagcugccccggguccacguuccagaaggcccugcugaucagcccccaccgcuuuggcgagaccaaggggaacuccgcgccgcucaucauccgggagcccuucaucgccugcggccccaacgagugcaagcacuuugcccugacccacuacgccgcgcagcccggcggguacuacaacggcacccgcggggaccggaauaagcugcgccaccucaucagcgugaagcugggcaagaucccgacgguggagaacuccaucuuccacauggccgccuggagcggguccgccugccaugacggcaaggaguggaccuacaucggcgucgacgggcccgacaacaacgcccugcucaagaucaaguauggcgaggcguacaccgacaccuaccacucguacgccaauaacauccugcggacgcaggaguccgccugcaacugcaucgggggcaacugcuaccugaugaucaccgauggcagcgccagcgggguguccgagugccgcuuccucaagauccgggagggccgcaucaucaaggagaucuuccccaccgggcgggugaagcacaccgaggaguguacgugcggcuucgccagcaacaagaccaucgagugcgcgugccgcgauaacuccuacaccgccaagcggcccuucgucaagcugaacguggagaucgacaccgccgagauccgccugaugugcacggacaccuaucucgacaccccgcggcccgacgacgggagcaucaccggccccugcgaguccaacggcgauaaggggucgggcgggaucaagggcggguucgugcaccagcgcauggccuccaagaucggccggugguacagccgcacgauguccaagaccgagcggaugggcauggggcuguacgucaaguaugacggcgaccccugggccgacagcgacgcgcuggccuucuccgggcucauggugagcaugaaggagccgggcugguauuccuucggguucgagaucaaggacaagaagugcgacgugcccugcaucggcaucgagaugguccaugacggcgggaaggagaccuggcacagcgccgccaccgccaucuacugccugaugggcuccgggcagcugcucugggacacggugaccggcguggacauggcgcuguga

SEQ ID NO: 29441 - RNA, 1401 nt, Artificial Sequence
  derived and/or modified CDS sequence (AUadapt) from InfluenzaB__AGX18450__NA
augcugcccaguaccauccagacccucacgcuguuccugaccuccggcggggugcuccugagccuguacgucuccgccagccucuccuaccugcuguacagugacauccuccugaaguucuccccgaccgagaucaccgccucgacgaugccccuggacugcgcgaacgccuccaacgugcaggccgugaaucgcagcgccaccaagggcgucacccuccugcugcccgagcccgaguggaccuacccgcggcucuccugccccgggagcacguuccagaaggcccugcugaucagcccccaccgcuuuggcgagaccaaggggaacuccgcgccccucaucauccgggagccguucaucgccugcggccccaacgagugcaagcacuucgcccugacccauuacgccgcgcagcccggcggguacuacaacggcacccgcggggaccggaacaagcugcgccaccucaucuccgugaagcugggcaagauccccacgguggagaauucgaucuuccacauggccgccugguccgggagcgccugccacgacggcaaggaguggaccuauaucggcgucgacgggccggacaacaacgcccugcucaagaucaaguacggcgaggcguacaccgacaccuaucacuccuacgccaacaacauccugcggacgcaggagagcgccugcaacuguaucgggggcaacugcuaccugaugaucaccgacggcagcgccuccggggugucggagugucgcuuccucaagauccgggagggccgcaucaucaaggagaucuuccccaccgggcgggugaagcacaccgaggagugcacgugcggcuucgccuccaacaagaccaucgagugugcgugccgcgacaacagcuacaccgccaagcggcccuucgucaagcugaacguggagaucgauaccgccgagauccgccugaugugcacggacaccuaccucgacacgccccggccggacgacggguccaucaccggccccugcgagaguaacggcgacaagggguccggcgggaucaagggcggguucgugcaccagcgcauggccagcaagaucggccggugguacucccgcaccaugucgaagaccgagcggaugggcauggggcuguaugucaaguacgacggcgaccccugggccgacuccgacgcgcuggccuucagcggggugaugguguccaugaaggagcccggcugguauagcuucggguucgagaucaaggacaagaagugcgacgucccgugcaucggcaucgagauggugcaugacggcgggaaggagaccuggcacuccgccgccaccgccaucuacugccucaugggcagcgggcagcugcugugggacacggugaccggcgucgacauggcgcucuga

SEQ ID NO: 29442 - RNA, 1401 nt, Artificial Sequence; identical to SEQ ID NO: 29001
  derived and/or modified CDS sequence (AUadapt) from InfluenzaB__AGX18461__NA

SEQ ID NO: 29443 - RNA, 1401 nt, Artificial Sequence
  derived and/or modified CDS sequence (AUadapt) from InfluenzaB__AGX18472__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcacgccgugaaccacuccgccaccaagggcgucacgccccuccugccggagcccgaguggaccuacccccgccugagcugccccggguccaccuuucagaaggcccuccugaucagcccgcaccgguucggcgagaccaaggggaacuccgcgccccugaucauccgcgagcccuucaucgccugcggccccaaugagugcaagcacuucgcccucacccacuacgccgcgcagccgggcggguacuauaacggcacccgcggggaccggaacaagcugcggcaccugaucucggugaagcucggcaagauccccacgguggagaacuccaucuuucacauggccgccuggagcggguccgccugccacgacggcaaggaguggaccuacaucggcgucgaugggcccgacaacaacgcccugcugaagaucaaguacggcgaggcguacaccgacaccuaucacagcuacgccaacaacauccuccgcacgcaggaguccgccugcaauugcaucgggggcaacugcuaccugaugaucaccgacggcagcgccagugggguguccgagugccgguuccugaagauccgcgagggccggaucaucaaggagaucuuccccaccgggcgcgugaagcacaccgaggagugcacgugcggcuuugccagcaacaagaccaucgagugcgcgugccgggacaacuccuauaccgccaagcgcccguucgucaagcucaacguggagaccgacacggccgagauccggcugaugugcaccgacaccuaccuggauacgccccgccccgacgacgggagcaucaccggccccugcgaguccaacggcgacaaggggaguggcgggaucaagggcggguucgugcaccagcggauggccuccaagaucggccgcugguacucgcggaccauguccaagaccgagcgcaugggcauggggcucuacgucaaguacgauggcgacccgugggccgacagcgacgcgcuggccuucuccggggugauggugagcaugaaggagcccggcugguauuccuucggguucgagaucaaggacaagaagugcgacguccccugcaucggcaucgagauggugcaugacggcgggaaggagaccuggcacagcgccgccacggccaucuacugccugaugggcuccgggcagcuccugugggacaccgugaccggcgucgacauggcgcuguga

SEQ ID NO: 29444 - RNA, 1401 nt, Artificial Sequence; identical to SEQ ID NO: 29001
  derived and/or modified CDS sequence (AUadapt) from InfluenzaB__AGX18483__NA

SEQ ID NO: 29445 - RNA, 1401 nt, Artificial Sequence; identical to SEQ ID NO: 28748
  derived and/or modified CDS sequence (AUadapt) from InfluenzaB__AGX18494__NA

SEQ ID NO: 29446 - RNA, 1401 nt, Artificial Sequence
  derived and/or modified CDS sequence (AUadapt) from InfluenzaB__AGX18505__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaacgaguguaagcacuucgcccugacccacuacgccgcgcagcccggcggguacuacaauggcacccgcggggaccggaacaagcugcgccaccucaucagcgugaagcugggcaagaucccgacgguggagaacuccaucuuccauauggccgccuggagcggguccgccugccacgacggcaaggaguggaccuacaucggcgucgacgggcccgauaacaacgcccugcucaagaucaaguacggcgaggcguacaccgacaccuaccauucguacgccaacaagauccugcggacgcaggaguccgccugcaacugcaucgggggcaauugcuaccugaugaucaccgacggcagcgccagcgggguguccgagugucgcuuccucaagauccgggagggccgcaucaucaaggagaucuuccccaccgggcgggugaagcacaccgaggagugcacgugcggcuucgccaguaacaagaccaucgagugcgcgugccgcgacaacuccuacaccgccaagcggcccuuugucaagcugaacguggagaccgacacggccgagauccgccugaugugcaccgacaccuaccucgacaccccgcggcccgaugacgggagcaucacgggccccugcgaguccaacggcgacaaggggucgggcgggaucaagggcggguuugugcaccagcgcauggccuccaagaucggccggugguacagccgcaccaucuccaagaccgagcggaugggcauggggcuguacgucaaguacgacggcgaucccugggccgacagcgacgcgcuggccuucuccggggugauggugagcaugaaggagccgggcugguacuccuuuggguucgagaucaaggacaagaagugcgacguccccugcaucggcaucgagauggugcacgauggcgggaaggagaccuggcacagcgccgccacggccaucuacugccucaugggcuccgggcagcugcugugggacaccgugaccggcgucgacauggcgcucuga

SEQ ID NO: 29447 - RNA, 1401 nt, Artificial Sequence
  derived and/or modified CDS sequence (AUadapt) from InfluenzaB__AGX18516__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccagcaacgugcaggccgugaaccgcuccgccaccaagggcgucacccuccugcugcccgagccggaguggaccuacccccggcucagcugccccggguccacguuucagaaggcccugcugaucucgccccaccgcuucggcgagaccaaggggaacuccgcgccgcucaucauccgggagcccuucaucgccuguggccccaacgagugcaagcacuucgcccugacccacuacgccgcgcagcccggcggguauuacaacggcacccgcggggaccggaacaagcugcgccaccucaucagugugaagcugggcaagaucccgacgguggagaacuccaucuuccacauggccgccuggagcggguccgccugccacgauggcaaggaguggaccuacaucggcgucgacgggcccgacaacaacgcccugcucaagaucaaguauggcgaggcguacaccgacaccuaccacagcuacgccaauaagauccugcggacgcaggaguccgccugcaacugcaucgggggcaacugcuaucugaugaucaccgacggcagcgccagcgggguguccgagugccgcuuccucaagauccgggagggccgcaucaucaaggagaucuuccccaccgggcgggugaagcauaccgaggagugcacgugcggcuucgccucgaacaagaccaucgagugugcgugccgcgacaacuccuacaccgccaagcggcccuucgucaagcugaacguggagaccgauacggccgagauccgccugaugugcaccgacaccuaccucgacaccccgcggcccgacgaugggagcaucacgggccccugcgaguccaacggcgacaaggggagcggcgggaucaagggcggguucgugcaucagcgcauggccuccaagaucggccggugguacagccgcaccaucuccaagaccgagcggaugggcauggggcuguacgucaaguacgacggcgaucccugggccgacagcgacgcgcuggccuucuccggggugauggugagcaugaaggagccgggcugguacuccuuuggguucgagaucaaggacaagaagugcgacguccccugcaucggcaucgagauggugcauggcgggggcaaggagaccuggcacagcgccgccacggccaucuacugccucaugggguccggccagcugcugugggacaccgugaccggcgucgacauggcgcucuga

SEQ ID NO: 29448 - RNA, 1401 nt, Artificial Sequence; identical to SEQ ID NO: 28748
  derived and/or modified CDS sequence (AUadapt) from InfluenzaB__AGX18527__NA

SEQ ID NO: 29449 - RNA, 1401 nt, Artificial Sequence; identical to SEQ ID NO: 28748
  derived and/or modified CDS sequence (AUadapt) from InfluenzaB__AGX18538__NA

SEQ ID NO: 29450 - RNA, 1401 nt, Artificial Sequence; identical to SEQ ID NO: 28748
  derived and/or modified CDS sequence (AUadapt) from InfluenzaB__AGX18549__NA

SEQ ID NO: 29451 - RNA, 1401 nt, Artificial Sequence; identical to SEQ ID NO: 28748
  derived and/or modified CDS sequence (AUadapt) from InfluenzaB__AGX18560__NA

SEQ ID NO: 29452 - RNA, 1401 nt, Artificial Sequence; identical to SEQ ID NO: 28748
  derived and/or modified CDS sequence (AUadapt) from InfluenzaB__AGX18571__NA

SEQ ID NO: 29453 - RNA, 1401 nt, Artificial Sequence
  derived and/or modified CDS sequence (AUadapt) from InfluenzaB__AGX18582__NA
augcugcccaguaccauccagacccucacgcuguuccugaccuccggcggggugcuccugagccuguacguccucgccucccugagcuaccugcucuauuccgacauccugcugaaguucagcccgaccgagaucaccgcccccacgaugccccucgacugcgcgaacgccuccaaugugcacgccgugaaccgcagcgccaccaagggcgucacccugcugcuccccgagccggagugggccuacccccggcuguccugccccgggaguaccuuccagaaggcgcugcucaucucgccccaccgcuucggcgagacgaaggggaacuccgccccgcugaucauccgggagcccuucaucgccuguggccccaacgagugcaagcacuucgcccugacccacuacgcggcccagcccggcggguauuacaacggcacccgcggggaccggaacaagcuccgccaccugaucuccgugaagcugggcaagaucccgaccguggagaauagcaucuuccacauggccgccugguccgggagcgccugccacgauggcaaggaguggacguacaucggcgucgacgggcccgacaacaacgcgcuccugaagaucaaguacggcgaggccuauaccgacaccuaccacuccuacgccaacaauauccugcggacccaggagagcgccugcaacugcaucgggggcaacugcuaucucaugaucacggacggcuccgccagcggggugagcgagugccgcuuccugaagauccgggagggccgcaucaucaaggagaucuuucccaccgggcgggugaagcacaccgaggagugcacgugcggcuucgcguccaacaagaccaucgagugcgccugucgcgacaacucguacaccgccaagcggcccuucgucaagcugaacguggagaccgauaccgccgagauccgccucaugugcacggacaccuaccuggacaccccgcggcccgacgauggguccaucaccggccccugcgagagcaacggcgacaagggguccggcgggaucaagggcggguucgugcaccagcgcauggccaguaagaucggccggugguacucccgcacgaugagcaagaccgagcggaugggcauggggcuguacgucaaguacgacggcgaccccugggcggauuccgacgcccucgccuucagcggggugaugguguccaugaaggagccgggcugguacagcuuuggguucgagaucaaggacaagaagugcgacguccccugcaucggcaucgagauggugcacgauggcgggaaggagaccuggcacuccgccgccaccgcgaucuacugccugaugggcagcgggcagcugcucugggacacggugaccggcgucgacauggcccuguga

SEQ ID NO: 29454 - RNA, 1401 nt, Artificial Sequence; identical to SEQ ID NO: 28748
  derived and/or modified CDS sequence (AUadapt) from InfluenzaB__AGX18593__NA

SEQ ID NO: 29455 - RNA, 1401 nt, Artificial Sequence; identical to SEQ ID NO: 28748
  derived and/or modified CDS sequence (AUadapt) from InfluenzaB__AGX18604__NA

SEQ ID NO: 29456 - RNA, 1401 nt, Artificial Sequence
  derived and/or modified CDS sequence (AUadapt) from InfluenzaB__AGX18615__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccgcuccgccaccaagggcgucacccuccugcugcccgagccggaguggaccuacccccggcucagcugccccggguccacguuccagaaggcccugcugaucagcccccaucgcuucggcgagaccaaggggaacuccgcgccgcucaucauccgggagcccuucaucgccugcggccccaacgagugcaagcacuuugcccugacccacuacgccgcgcagcccggcggguacuacaacggcacccgcggggaccggaauaagcugcgccaccucaucucggugaagcugggcaagaucccgacgguggagaacuccaucuuccacauggccgccuggagcggguccgccugucacgacggcaaggaguggaccuacaucggcgucgacgggcccgacaacaacgcccugcucaagaucaaguauggcgaggcguacaccgacaccuaccacagcuacgccaauaagauccugcggacgcaggaguccgccugcaacugcaucgggggcaacugcuaccugaugaucaccgauggcagcgccucggggguguccgagugccgcuuccucaagauccgggagggccgcaucaucaaggagaucuuccccaccgggcgggugaagcacaccgaggaguguacgugcggcuucgccagcaacaagaccaucgagugcgcgugccgcgacaauuccuacaccgccaagcggcccuucgucaagcugaacguggagaccgacacggccgagauccgccugaugugcaccgacaccuaucucgacaccccgcggcccgacgacgggagcaucacgggccccugcgaguccaacggcaauaaggggagcggcgggaucaagggcggguucgugcaccagcgcauggccuccaagaucggccggugguacucgcgcaccauguccaagaccgagcggaugggcauggggcuguacgucaaguacgauggcgaccccugggccgacagcgacgcgcuggccuucuccggggugauggugagcaugaaggagccgggcugguauuccuucggguucgagaucaaggacaagaagugcgacguccccugcaucggcaucgagauggugcaugacggcgggaaggagaccuggcacagcgccgccacggccaucuacugccucaugggcuccgggcagcugcugugggacaccgugaccggcgucgacauggcgcucuga

SEQ ID NO: 29457 - RNA, 1401 nt, Artificial Sequence
  derived and/or modified CDS sequence (AUadapt) from InfluenzaB__AGX18626__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuucagaaggcccugcugaucucgccccaccgcuucggcgagaccaaggggaacuccgcgccgcucauccugcgggagcccuucaucgccugcggccccaaugagugcaagcacuucgcccugacccacuacgccgcgcagcccggcggguauuacaacggcacccgcggggaccggaacaagcuccgccaccugaucagcgugaagcugggcaagaucccgacgguggagaauuccaucuuccacauggccgccuggagcggguccgccugccacgauggcaaggaguggaccuacaucggcgucgacgggcccgacaacaacgcccuccugaagaucaaguacggcgaggcguauaccgacaccuaccacagcuacgccaauaagauccugcggacgcaggaguccgccugcaacugcaucgggggcaacugcuaccucaugaucaccgauggcagcgccagcgggguguccgagugccgcuuccugaagauccgggagggccgcaucaucaaggagaucuuccccaccgggcgggugaagcauaccgaggagugcacgugcggcuucgccucgaacaagaccaucgagugcgcgugucgcgacaacuccuacaccgccaagcggcccuucgucaagcugaacguggagaccgauacggccgagauccgccucaugugcaccgacaccuaccuggacaccccgcggcccgacgacgggaguaucacgggccccugcgaguccaacggcgacaaggggagcggcgggaucaagggcggguucgugcaucagcgcauggccuccaagaucggccggugguacagccgcaccauguccaagaccgagcggaugggcauggggcuguacgucaaguacgacggcgaccccugggccgauagcgacgcgcucgccuucuccggggugauggugagcaugaaggagccgggcugguacuccuuuggguucgagaucaaggacaagaagugcgacguccccugcaucggcaucgagauggugcacgauggcgggaaggagaccuggcacagcgccgccacggccaucuacugccugaugggcuccgggcagcugcucugggacaccgugaccggcgucgacauggcgcuguga

SEQ ID NO: 29458 - RNA, 1401 nt, Artificial Sequence; identical to SEQ ID NO: 28748
  derived and/or modified CDS sequence (AUadapt) from InfluenzaB__AGX18637__NA

SEQ ID NO: 29459 - RNA, 1401 nt, Artificial Sequence; identical to SEQ ID NO: 28748
  derived and/or modified CDS sequence (AUadapt) from InfluenzaB__AGX18648__NA

SEQ ID NO: 29460 - RNA, 1401 nt, Artificial Sequence; identical to SEQ ID NO: 28748
  derived and/or modified CDS sequence (AUadapt) from InfluenzaB__AGX18659__NA

SEQ ID NO: 29461 - RNA, 1401 nt, Artificial Sequence; identical to SEQ ID NO: 28748
  derived and/or modified CDS sequence (AUadapt) from InfluenzaB__AGX18670__NA

SEQ ID NO: 29462 - RNA, 1401 nt, Artificial Sequence
  derived and/or modified CDS sequence (AUadapt) from InfluenzaB__AGX18681__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuucagaaggcccugcugaucucgccccaccgcuucggcgagaccaaggggaacuccgcgccgcucaucgugcgggagcccuucaucgccugcggccccaaugagugcaagcacuucgcccugacccacuacgccgcgcagcccggcggguauuacaacggcacccgcggggaccggaacaagcugcgccaccucaucagcgugaagcugggcaagaucccgacggucgagaauuccaucuuccacauggccgccuggagcggguccgccugccacgauggcaaggaguggaccuacaucggcguggacgggcccgacaacaacgcccugcucaagaucaaguacggcgaggcguauaccgacaccuaccacagcuacgccaauaagauccugcggacgcaggaguccgccugcaacugcaucgggggcaacugcuaccugaugaucaccgauggcagcgccagcgggguguccgagugccgcuuccucaagauccgggagggccgcaucaucaaggagaucuuccccaccgggcgggucaagcauaccgaggagugcacgugcggcuucgccucgaacaagaccaucgagugcgcgugucgcgacaacuccuacaccgccaagcggcccuucgugaagcugaacguggagaccgauacggccgagauccgccugaugugcaccgacaccuaccucgacaccccgcggcccgacgacgggaguaucacgggccccugcgaguccaacggcgacaaggggagcggcgggaucaagggcggguucguccaucagcgcauggccuccaagaucggccggugguacagccgcaccauguccaagaccgagcggaugggcauggggcuguacgugaaguacgacggcgaccccugggccgauagcgacgcgcuggccuucuccggggugauggucagcaugaaggagccgggcugguacuccuuuggguucgagaucaaggacaagaagugcgacgugcccugcaucggcaucgagauggugcacgauggcgggaaggagaccuggcacagcgccgccacggccaucuacugccucaugggcuccgggcagcugcugugggacaccgucaccggcguggacauggcgcucuga

SEQ ID NO: 29463 - RNA, 1401 nt, Artificial Sequence; identical to SEQ ID NO: 28748
  derived and/or modified CDS sequence (AUadapt) from InfluenzaB__AGX18692__NA

SEQ ID NO: 29464 - RNA, 1401 nt, Artificial Sequence
  derived and/or modified CDS sequence (AUadapt) from InfluenzaB__AGX18703__NA
augcugcccaguaccauccagacccucacgcuguuccugaccuccggcggggugcuccugagccuguacgucuccgccagccucuccuaccugcuguacagugacauccuccugaaguucccguccaccgagaucaccgcccccacgaugccccuggacugcgcgaacgccagcaacgugcaggccgugaaucucuccgccaccaagggcgucacccugcugcuccccgagccggaguggaccuacccccgccugagcugccccggguccacguuccagaaggcccugcucaucagcccccaccgguucggcgagaccaaggggaauuccgcgccgcugaucauccgcgagcccuucaucgccugcggccccaaggagugcaagcacuucgcccugacccacuaugccgcgcagcccggcggguacuacaacggcacccgcggggaccggaacaagcuccggcaccugaucucggugaagcugggcaagaucccgacgguggagaauuccaucuuccacauggccgccuggagcggguccgccugccacgacggcaaggaguggaccuacaucggcgucgaugggcccgacaacaacgcccuccugaagaucaaguacggcgaggcguacaccgacaccuaucacagcuacgccaacaacauccugcgcacgcaggaguccgccugcaacuguaucgggggcaacugcuaccucaugaucaccgacggcagcgccucggggguguccgagugccgguuucugaagauccgcgagggccggaucaucaaggagaucuuccccaccgggcgcaucaagcacaccgaggagugcacgugcggcuucgccagcaauaagaccaucgagugcgcgugccgggacaacuccuacaccgccaagcgccccuucgugaagcugaacgucgagaccgauacggccgagauccggcucaugugcaccgagaccuaccuggacaccccgcgccccgacgacgggagcaucacgggccccugcgaguccaauggcgacaaggggagcggcgggaucaagggcggguucgugcaccagcggauggccuccaagaucggccgcugguacucgcggaccauguccaagaccgagcgcaugggcauggggcuguaugugaaguacgacggcgaccccugggccgacagcgacgcgcucgccuucuccggggucauggugaguauggaggagccgggcugguacuccuucggguucgagaucaaggacaagaagugcgacgugcccugcaucggcaucgagaugguccaugacggcgggaaggagaccuggcacagcgccgccacggccaucuacugccugaugggcuccgggcagcugcucugggacaccgugaccggcgugaacauggcgcuguga

SEQ ID NO: 29465 - RNA, 1401 nt, Artificial Sequence; identical to SEQ ID NO: 28748
  derived and/or modified CDS sequence (AUadapt) from InfluenzaB__AGX18714__NA

SEQ ID NO: 29466 - RNA, 1401 nt, Artificial Sequence; identical to SEQ ID NO: 28748
  derived and/or modified CDS sequence (AUadapt) from InfluenzaB__AGX18725__NA

SEQ ID NO: 29467 - RNA, 1401 nt, Artificial Sequence
  derived and/or modified CDS sequence (AUadapt) from InfluenzaB__AGX18736__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaacgaguguaagcacuucgcccugacccacuacgccgcgcagcccggcggguacuacaauggcaccgggggcgaccgcaacaagcugcggcaccucaucagcgugaagcuggggaagaucccgacgguggagaacuccaucuuccauauggccgccuggagcggcuccgccugccacgacggcaaggaguggaccuacaucggggucgacggccccgauaacaacgcccugcucaagaucaaguacggggaggcguacaccgacaccuaccauucguacgccaacaagauccugcgcacgcaggaguccgccugcaacugcaucggcggcaauugcuaccugaugaucaccgacgggagcgccagcggcguguccgagugucgguuccucaagauccgcgaggggcggaucaucaaggagaucuuccccaccggccgcgugaagcacaccgaggagugcacgugcggguucgccaguaacaagaccaucgagugcgcgugccgggacaacuccuacaccgccaagcgccccuuugucaagcugaacguggagaccgacacggccgagauccggcugaugugcaccgacaccuaccucgacaccccgcgccccgaugacggcagcaucacgggccccugcgaguccaacggggacaagggcucggggggcaucaagggcggguuugugcaccagcggauggccuccaagaucggccgcugguacagccggaccauguccaagaccgagcgcauggggaugggccuguacgucaaguacgacggggaucccugggccgacagcgacgcgcuggccuucuccggcgugauggugagcaugaaggagccggggugguacuccuuuggcuucgagaucaaggacaagaagugcgacguccccugcaucggcaucgagauggugcacgaugggggcaaggagaccuggcacagcgccgccacggccaucuacugccucaugggguccggccagcugcugugggacaccgugaccggcgucgacauggcgcucuga

SEQ ID NO: 29468 - RNA, 1401 nt, Artificial Sequence; identical to SEQ ID NO: 28748
  derived and/or modified CDS sequence (AUadapt) from InfluenzaB__AGX18758__NA

SEQ ID NO: 29469 - RNA, 1401 nt, Artificial Sequence; identical to SEQ ID NO: 28748
  derived and/or modified CDS sequence (AUadapt) from InfluenzaB__AGX18769__NA

SEQ ID NO: 29470 - RNA, 1401 nt, Artificial Sequence; identical to SEQ ID NO: 29207
  derived and/or modified CDS sequence (AUadapt) from InfluenzaB__AGX18780__NA

SEQ ID NO: 29471 - RNA, 1401 nt, Artificial Sequence; identical to SEQ ID NO: 28748
  derived and/or modified CDS sequence (AUadapt) from InfluenzaB__AGX18791__NA

SEQ ID NO: 29472 - RNA, 1401 nt, Artificial Sequence; identical to SEQ ID NO: 28748
  derived and/or modified CDS sequence (AUadapt) from InfluenzaB__AGX18802__NA

SEQ ID NO: 29473 - RNA, 1401 nt, Artificial Sequence
  derived and/or modified CDS sequence (AUadapt) from InfluenzaB__AGX18813__NA
augcugcccaguaccauccagacccucacgcuguuccugaccuccggcggggugcuccugagccuguacgucuccgccagccucuccuaccugcuguacagugacauccuccugaaguucccguccaccgagaucaccgcccccacgaugccccuggacugcgcgaacgccagcaacgugcaggccgugaaucgcuccgccaccaagggcgucacccuccugcugcccgagccggaguggaccuacccccggcucagcugccccggguccacguuccagaaggcccugcugaucagcccccaccgcuucggcgagaccaaggggaauuccgcgccgcucaucauccgggagcccuucaucgccugcggccccaaggagugcaagcacuucgcccugacccacuaugccgcgcagcccggcggguacuacaacggcacccgcggggaccggaacaagcugcgccaccucaucucggugaagcugggcaagaucccgacgguggagaauuccaucuuccacauggccgccuggagcggguccgccugccacgacggcaaggaguggaccuacaucggcgucgaugggcccgacaacaacgcccugcucaagaucaaguacggcgaggcguacaccgacaccuaucacagcuacgccaacaacauccugcggacgcaggaguccgccugcaacuguaucgggggcaacugcuaccugaugaucaccgacggcagcgccucggggguguccgagugccgcuuucucaagauccgggagggccgcaucaucaaggagaucuuccccaccgggcggaucaagcacaccgaggagugcacgugcggcuucgccagcaauaagaccaucgagugcgcgugccgcgacaacuccuacaccgccaagcggcccuucgugaagcugaacgucgagaccgauacggccgagauccgccugaugugcaccgagaccuaccucgacaccccgcggcccgacgacgggagcaucacgggccccugcgaguccaauggcgacaaggggagcggcgggaucaagggcggguucgugcaccagcgcauggccuccaagaucggccggugguacucgcgcaccauguccaagaccgagcggaugggcauggggcuguaugugaaguacgacggcgaccccugggccgacagcgacgcgcuggucuucuccggggugauggugaguauggaggagccgggcugguacuccuucggguucgagaucaaggacaagaagugcgacguccccugcaucggcaucgagauggugcaugacggcgggaaggagaccuggcacagcgccgccacggccaucuacugccucaugggcuccgggcagcugcugugggacaccgugaccggcgucaacauggcccucuga

SEQ ID NO: 29474 - RNA, 1401 nt, Artificial Sequence; identical to SEQ ID NO: 29207
  derived and/or modified CDS sequence (AUadapt) from InfluenzaB__AGX18824__NA

SEQ ID NO: 29475 - RNA, 1401 nt, Artificial Sequence
  derived and/or modified CDS sequence (AUadapt) from InfluenzaB__AGX18846__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccucgaaugugcaggccgugaaccgcuccgccaccaagggcgucacccuccugcugagcgagcccgaguggaccuacccgcggcucuccugccccgggagcacguuccagaaggcccugcugaucagcccccaucgcuucggcgagaccaaggggaacuccgcgccccucaucauccgggagccguucaucgccugcggccccaacgagugcaagcauuucgcccugacccacuacgccgcgcagcccggcggguacuacaacggcacccgcggggaucggaacaagcugcgccaccucaucuccgugaagcugggcaagauccccacgguggagaacucgaucuuccacauggccgccugguccgggagcgccugucacgacggcaaggaguggaccuacaucggcgucgacgggccggacaacaaugcccugcucaagaucaaguacggcgaggcguacaccgacaccuaccacuccuacgccaauaagauccugcggacgcaggagagcgccugcaacugcaucgggggcaacugcuaccugaugaucaccgauggcagcgccuccggggugucggagugccgcuuccucaagauccgggagggccgcaucaucaaggagaucuuccccaccgggcgggugaagcacaccgaggaguguacgugcggcuucgccuccaacaagaccaucgagugcgcgugccgcgacaauagcuacaccgccaagcggcccuucgucaagcugaacguggagaccgacacggccgagauccgccugaugugcaccgacaccuaucucgacacgccccggccggacgacggguccaucaccggccccugcgagagcaacggcgauaagggguccggcgggaucaagggcggguucgugcaccagcgcauggccagcaagaucggccggugguacucccgcaccaugucgaagaccgagcggaugggcauggggcuguacgucaaguaugacggcgaccccugggccgacuccgacgcgcuggccuucagcggggugaugguguccaugaaggagcccggcugguacaguuucggguucgagaucaaggacaagaagugcgacgucccgugcaucggcaucgagauggugcaugacggcgggaaggagaccuggcacuccgccgccacggccaucuacugccucaugggcagcgggcagcugcugugggacaccgugaccggcgucgacauggcgcucuga

SEQ ID NO: 29476 - RNA, 1401 nt, Artificial Sequence; identical to SEQ ID NO: 28748
  derived and/or modified CDS sequence (AUadapt) from InfluenzaB__AGX18857__NA

SEQ ID NO: 29477 - RNA, 1401 nt, Artificial Sequence; identical to SEQ ID NO: 29475
  derived and/or modified CDS sequence (AUadapt) from InfluenzaB__AGX18868__NA

SEQ ID NO: 29478 - RNA, 1401 nt, Artificial Sequence; identical to SEQ ID NO: 29475
  derived and/or modified CDS sequence (AUadapt) from InfluenzaB__AGX18879__NA

SEQ ID NO: 29479 - RNA, 1401 nt, Artificial Sequence
  derived and/or modified CDS sequence (AUadapt) from InfluenzaB__AGX18890__NA
augcugcccaguaccauccagacccucacgcuguuccugaccuccggcggggugcuccugagccuguacgucuccgccagccucuccuaccugcuguacagugacauccuccugaaguucccguccaccgagaucaccgcccccacgaugccccuggacugcgcgaacgccagcaacgugcaggccgugaaucgcuccgccaccaagggcgucacccuccugcugcccgagccggaguggaccuacccccggcucagcugccccggguccacguuccagaaggcccugcugaucucgccccaccgcuucggcgagaccaaggggaauuccgcgccgcucaucauccgggagcccuucaucgccugcggccccaaggagugcaagcacuucgcccugacccacuaugccgcgcagcccggcggguacuacaacggcacccgcggggaccggaacaagcugcgccaccucaucagcgugaagcugggcaagaucccgacgguggagaauuccaucuuccacauggccgccuggagcggguccgccugccacgacggcaaggaguggaccuacaucggcgucgaugggcccgacaacaacgcccugcucaagaucaaguacggcgaggcguacaccgacaccuaucacucguacgccaacaacauccugcggacgcaggaguccgccugcaacuguaucgggggcaacugcuaccugaugaucaccgacggcagcgccagcgggguguccgagugccgcuuucucaagauccgggagggccgcaucaucaaggagaucuuccccaccgggcggaucaagcacaccgaggagugcacgugcggcuucgccucgaauaagaccaucgagugcgcgugccgcgacaacuccuacaccgccaagcggcccuucgugaagcugaacgucgagaccgauacggccgagauccgccugaugugcaccgagaccuaccucgacaccccgcggcccgacgacgggagcaucacgggccccugcgaguccaauggcgacaaggggagcggcgggaucaagggcggguucgugcaccagcgcauggccuccaagaucggccggugguacucgcgcaccauguccaagaccgagcggaugggcauggggcuguaugugaaguacgacggcgaccccugggccgacagcgacgcgcuggccuucuccggggucauggugaguauggaggagccgggcugguacuccuucggguucgagaucaaggacaagaagugcgacgugcccugcaucggcaucgagaugguccaugacggcgggaaggagaccuggcacagcgccgccacgaccaucuacugccucaugggcuccgggcagcugcugugggacaccgugaccggcgugaacauggcccucuga

SEQ ID NO: 29480 - RNA, 1401 nt, Artificial Sequence; identical to SEQ ID NO: 28748
  derived and/or modified CDS sequence (AUadapt) from InfluenzaB__AGX18912__NA

SEQ ID NO: 29481 - RNA, 1401 nt, Artificial Sequence
  derived and/or modified CDS sequence (AUadapt) from InfluenzaB__AGX18923__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccucgaaugugcaggccgugaaccgcuccgccaccaagggcgucacccuccugcugcccgagccggaguggaccuacccccggcucagcugccccggguccacguuccagaaggcccugcugaucagcccccaucgcuucggcgagaccaaggggaacuccgcgccgcucaucauccgggagcccuucaucgccugcggccccaacgagugcaagcacuuugcccugacccacuacgccgcgcagcccggcggguacuacaaccgcacccggggcgaccgcaauaagcugcggcaccucaucagcgugaagcuggggaagaucccgacgguggagaacuccaucuuccacauggccgccuggagcggcuccgccugucacgacgggaaggaguggaucuacaucggcgucgacggccccgacaacaacgcccugcucaagaucaaguauggggaggcguacaccgacaccuaccacucguacgccaauaagauccugcgcacccaggaguccgccugcaacugcaucggcgggaacugcuaccugaugaucacggauggcagcgccagcggcguguccgagugccgguuccucaagauccgcgaggggcggaucaucaaggagaucuuccccaccggccgcgugaagcacaccgaggaguguacgugcggguucgccagcaacaagaccaucgagugcgcgugccgggacaauuccuacaccgccaagcgccccuucgucaagcugaacguggagaccgacaccgccgagauccggcugaugugcacggacaccuaucucgacaccccgcgccccgacgacggcagcaucaccgggcccugcgaguccaacggcgauaagggcucggggggcaucaagggcggguucgugcaccagcggauggccuccaagaucgggcgcugguacagccggacgauguccaagaccgagcgcaugggcaugggccuguacgucaaguacgauggggaccccugggccgacagcgacgcgcuggccuucuccggcgugauggugagcaugaaggagccggggugguauuccuucggcuucgagaucaaggacaagaagugcgacguccccugcaucgggaucgagauggugcaugacggcggcaaggagaccuggcacagcgccgccaccgccaucuacugccucaugggguccggccagcugcugugggacacggugaccggggucgacauggcgcucuga

SEQ ID NO: 29482 - RNA, 1401 nt, Artificial Sequence; identical to SEQ ID NO: 28748
  derived and/or modified CDS sequence (AUadapt) from InfluenzaB__AGX18934__NA

SEQ ID NO: 29483 - RNA, 1401 nt, Artificial Sequence
  derived and/or modified CDS sequence (AUadapt) from InfluenzaB__AGX18956__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuucagaaggcccugcugaucucgccccaccgcuucggcgagaccaaggggaacuccgcgccgcucaucauccgggagcccuucaucgccugcggccccaaugagugcaagcacuucgcccugacccacuacgccgcgcagcccggcggguauuacaacggcacccgcggggaccggaacaagcugcgccaccucaucagcgugaagcugggcaagaucccgacgguggagaauuccaucuuccacgucgccgccuggagcggguccgccugccacgauggcaaggaguggaccuacaucggcguggacgggcccgacaacaacgcccugcucaagaucaaguacggcgaggcguauaccgacaccuaccacagcuacgccaauaagauccugcggacgcaggaguccgccugcaacugcaucgggggcaacugcuaccugaugaucaccgauggcagcgccagcgggguguccgagugccgcuuccucaagauccgggagggccgcaucaucaaggagaucuuccccaccgggcgggucaagcauaccgaggagugcacgugcggcuucgccucgaacaagaccaucgagugcgcgugucgcgacaacuccuacaccgccaagcggcccuucgugaagcugaacguggagaccgauacggccgagauccgccugaugugcaccgacaccuaccucgacaccccgcggcccgacgacgggaguaucacgggccccugcgaguccaacggcgacaaggggagcggcgggaucaagggcggguucguccaucagcgcauggccuccaagaucggccggugguacagccgcaccauguccaagaccgagcggaugggcauggggcuguacgugaaguacgacggcgaccccugggccgauagcgacgcgcuggccuucuccggggugauggucagcaugaaggagccgggcugguacuccuuuggguucgagaucaaggacaagaagugcgacgugcccugcaucggcaucgagauggugcacgauggcgggaaggagaccuggcacagcgccgccacggccaucuacugccucaugggcuccgggcagcugcugugggacaccgucaccggcguggacauggcgcucuga

SEQ ID NO: 29484 - RNA, 1401 nt, Artificial Sequence
  derived and/or modified CDS sequence (AUadapt) from InfluenzaB__AGX18967__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacgccccuccugccggagcccgaguggaccuacccccggcugagcugccccggguccaccuuucagaaggcccuccugaucagcccgcaccgcuucggcgagaccaaggggaacuccgcgccccugaucauccgggagcccuucaucgccugcggccccaaugagugcaagcacuucgcccucacccacuacgccgcgcagccgggcggguauuacaacggcacccgcggggaccggaacaagcugcgccaccugaucagcgugaagcucggcaagauccccacgguggagaauuccaucuuccacauggccgccuggagcggguccgccugccacgauggcaaggaguggaccuacaucggcgucgacgggcccgacaacaacgcccugcugaagaucaaguacggcgaggcguauaccgacaccuaccacucguacgccaauaagauccuccggacgcaggaguccgccugcaacugcaucgggggcaacugcuaccugaugaucaccgauggcagcgccagcgggguguccgagugccgcuuccugaagauccgggagggccgcaucaucaaggagaucuuccccaccgggcgggugaagcauaccgaggagugcacgugcggcuucgccagcaacaagaccaucgagugcgcgugucgcgacaacuccuacaccgccaagcggccguucgucaagcucaacguggagaccgauacggccgagauccgccugaugugcaccgacaccuaccuggacacgccccggcccgacgacgggaguaucaccggccccugcgaguccaacggcgacaaggggucgggcgggaucaagggcggguucgugcaucagcgcauggccuccaagaucggccggugguacagccgcaccauguccaagaccgagcggaugggcauggggcucuacgucaaguacgacggcgacccgugggccgauagcgacgcgcuggccuucuccggggugauggugagcaugaaggagcccggcugguacuccuuuggguucgagaucaaggacaagaagugcgacguccccugcaucggcaucgagauggugcacgauggcgggaaggagaccuggcacagcgccgccacggccaucuacugccugaugggcuccgggcagcuccugugggacaccgugaccggcgucgacauggcgcuguga

SEQ ID NO: 29485 - RNA, 1401 nt, Artificial Sequence; identical to SEQ ID NO: 29207
  derived and/or modified CDS sequence (AUadapt) from InfluenzaB__AGX18978__NA

SEQ ID NO: 29486 - RNA, 1401 nt, Artificial Sequence
  derived and/or modified CDS sequence (AUadapt) from InfluenzaB__AGX18989__NA
augcugcccaguaccauccagacccucacgcuguuccugaccuccggcggggugcuccugagccuguacgucuccgccagccucuccuaccugcuguauucggacauccuccugaaguucuccccgaccgagaucaccgcccccacgaugccccuggacuacgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaacgaguguaagcacuucgcccugacccacuacgccgcgcagcccggcggguacuacaauggcacccgcggggaccggaacaagcugcgccaccucaucucggugaagcugggcaagaucccgacgguggagaacuccaucuuccauauggccgccuggagcggguccgccugccacgacggcaaggaguggaccuacaucggcgucgacgggcccgauaacaacgcccugcucaagaucaaguacggcgaggcguacaccgacaccuaccauagcuacgccaacaagauccugcggacgcaggaguccgccugcaacugcaucgggggcaauugcuaccugaugaucaccgacggcagcgccucggggguguccgagugucgcuuccucaagauccgggagggccgcaucaccaaggagaucuuccccaccgggcgggugaagcacacggaggagugcacgugcggcuucgccaguaacaagaccaucgagugcgcgugccgcgacaacuccuacaccgccaagcggcccuuugucaagcugaacguggagaccgacaccgccgagauccgccugaugugcaccgacaccuaccucgacacgccgcggcccgaugacgggagcaucaccggccccugcgaguccaacggcgacaaggggagcggcgggaucaagggcggguuugugcaccagcgcauggccuccaagaucggccggugguacucgcgcaccauguccaagaccgagcggaugggcauggggcuguacgucaaguacgacggcgaucccugggccgacagcgacgcgcuggccuucuccggggugauggugagcaugaaggagccgggcugguacuccuuuggguucgagaucaaggacaagaagugcgacguccccugcaucggcaucgagauggugcacgauggcgggaaggagacguggcacagcgccgccaccgccaucuacugccucaugggcuccgggcagcugcugugggacaccgugaccggcgucgacauggcgcucuga

SEQ ID NO: 29487 - RNA, 1401 nt, Artificial Sequence
  derived and/or modified CDS sequence (AUadapt) from InfluenzaB__AGX19000__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccucgaaugugcacgccgugaaccgcuccgccaccaagggcgucacccuccugcugcccgagccggaguggaccuacccccggcucagcugccccggguccacguuccagaaggcccugcugaucagcccccaucgcuucggcgagaccaaggggaacuccgcgccgcucaucauccgggagcccuucaucgccugcggccccaacgagugcaagcauuucgcccugaccuacuacgccgcgcagcccggcggguacuacaacggcacccgcggggaccggaauaagcugcgccaccucaucagcgugaagcugggcaagaucccgacgguggagaacuccaucuuccacauggccgccuggagcggguccgccugucacgacggcaaggaguggaccuacaucggcgucgacgggcccgacaacaaugcccugcucaagaucaaguacggcgaggcguacaccgacaccuaccacucguacgccaauaacauccugcggacgcaggaguccgccugcaacugcaucgggggcaacugcuaucugaugaucaccgacggcagcgccagcgggguguccgagugccgcuuccucaagauccgggagggccgcaucaucaaggagaucuuccccaccgggcgggugaagcacaccgaggaguguacgugcggcuucgccagcaacaagaccaucgagugcgcgugccgcgauaacuccuacaccgccaagcggcccuucgucaagcugaacguggagaccgacacggccgagauccgccugaugugcaccgauaccuaccucgacaccccgcggcccgacgacgggagcaucacgggccccugcgaguccaacggcgauaaggggucgggcgggaucaagggcggguucgugcaccagcgcauggccuccaagaucggccggugguacagccgcaccauguccaagaccgagcggaugggcauggggcuguacgucaaguaugacggcgaccccugggccgacagcgacgcgcuggccuucuccggggugauggugagcaugaaggagccgggcugguauuccuucggguucgagaucaaggacaagaagugcgacguccccugcaucggcaucgagauggugcaugacggcgggaaggagaccuggcacagcgccgccacggccaucuacugccucaugggcuccgggcagcugcugugggacaccgugaccggcgucgacauggcgcucuga

SEQ ID NO: 29488 - RNA, 1401 nt, Artificial Sequence; identical to SEQ ID NO: 28748
  derived and/or modified CDS sequence (AUadapt) from InfluenzaB__AGX19011__NA

SEQ ID NO: 29489 - RNA, 1401 nt, Artificial Sequence; identical to SEQ ID NO: 28748
  derived and/or modified CDS sequence (AUadapt) from InfluenzaB__AGX19022__NA

SEQ ID NO: 29490 - RNA, 1401 nt, Artificial Sequence
  derived and/or modified CDS sequence (AUadapt) from InfluenzaB__AGX19033__NA
augcugcccaguaccauccagacccucacgcuguuccugaccuccggcggggugcuccugagccuguacgucuccgccucgcucuccuaccugcuguacagcgauauccuccugaaguucccguccaccgagaucaccgcccccacgaugccccugaacugcgcgaacgccagcaacgugcaggccgugaaccgcuccgccaccaagggcgucacccuccugcugcccgagccggaguggaccuauccccggcucucgugccccggguccacguuccagaaggcccugcugaucagcccccaccgcuucggcgagaccaaggggaacuccgcgccgcucaucauccgggagcccuuuaucgccugcggccccaaggagugcaagcacuucgcccugacccacuacgccgcgcagcccggcggguacuauaacggcacccgcggggaccggaacaagcugcgccaccucaucagcgugaagcugggcaagaucccgacgguggagaacuccaucuuccacauggccgccuggaguggguccgccugccacgacggcaaggaguggaccuacaucggcgucgacgggcccgacaacaaugcccugcucaagaucaaguacggcgaggcguacaccgacaccuaccacagcuacgccaauaacauccugcggacgcaggaguccgccugcaacugcaucgggggcaacugcuaccugaugaucaccgauggcucggccagcgggguguccgagugccgcuuccucaagauccgggagggccgcaucaucaaggagaucuuccccaccgggcggaucaagcacaccgaggagugcacguguggcuucgccagcaacaagaccaucgagugcgcgugccgcgacaacuccuacaccgccaagcggcccuuugugaagcugaacgucgagaccgacacggccgagauccgccugaugugcaccgagaccuaccucgacaccccgcggcccgacgacgggaguaucacgggccccugcgaguccaacggcgacaaggggagcgagggcaucaagggcggguucgugcaccagcgcauggccuccaagaucgggcggugguacagucgcaccauguccaagaccgagcggaugggcaugggccuguacgugaaguacgacggggaccccugggccgacucggacgcgcuggccuuuuccggcgucauggugagcauggaggagccggggugguacuccuucggcuucgagaucaaggacaagaagugcgacgugcccuguaucgggaucgagaugguccacgacggcggcaaggagaccuggcacagcgccgccacggccaucuacugccucaugggguccggccagcugcugugggacaccgugaccggggugaacauggcgcucuga

SEQ ID NO: 29491 - RNA, 1401 nt, Artificial Sequence; identical to SEQ ID NO: 28748
  derived and/or modified CDS sequence (AUadapt) from InfluenzaB__AGX19044__NA

SEQ ID NO: 29492 - RNA, 1401 nt, Artificial Sequence; identical to SEQ ID NO: 28748
  derived and/or modified CDS sequence (AUadapt) from InfluenzaB__AGX19055__NA

SEQ ID NO: 29493 - RNA, 1401 nt, Artificial Sequence
  derived and/or modified CDS sequence (AUadapt) from InfluenzaB__AGX19066__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccucgaaugugcaggccgugaaccgcuccgccaccaagggcgucacccuccugcugcccgagccggaguggaccuacccccggcucagcugccccggguccacguuccagaaggcccugcugaucagcccccaucgcuucggcgagaccaaggggaacuccgcgccgcucaucauccgggagcccuucaucgccugcggccccaacgagugcaagcacuuugcccugacccacuacgccgcgcagcccggcggguacuacaacggcacccgcggggaccggaauaagcugcgccaccucaucagcgugaagcugggcaagaucccgacgguggagaacuccaucuuccacauggccgccuggagcggguccgccugucacgacggcaaggaguggaucuacaucggcgucgacgggcccgacaacaacgcccugcucaagaucaaguauggcgaggcguacaccgacaccuaccacucguacgccaauaagauccugcggacccaggaguccgccugcaacugcaucgggggcaacugcuaccugaugaucacggauggcagcgccagcgggguguccgagugccgcuuccucaagauccgggagggccgcaucaucaaggagaucuuccccaccgggcgggugaagcacaccgaggaguguacgugcggcuucgccagcaacaagaccaucgagugcgcgugccgcgacaauuccuacaccgccaagcggcccuucgucaagcugaacguggagaccgacaccgccgagauccgccugaugugcacggacaccuaucucgacaccccgcggcccgacgacgggagcaucaccggccccugcgaguccaacggcgauaaggggucgggcgggaucaagggcggguucgugcaccagcgcauggccuccaagaucggccggugguacagccgcacgauguccaagaccgagcggaugggcauggggcuguacgucaaguacgauggcgaccccugggccgacagcgacgcgcuggccuucuccggggugauggugagcaugaaggagccgggcugguauuccuucggguucgagaucaaggacaagaagugcgacguccccugcaucggcaucgagauggugcaugacggcgggaaggagaccuggcacagcgccgccaccgccaucuacugccucaugggcuccgggcagcugcugugggacacggugaccggcgucgacauggcgcucuga

SEQ ID NO: 29494 - RNA, 1401 nt, Artificial Sequence
  derived and/or modified CDS sequence (AUadapt) from InfluenzaB__AGX19077__NA
augcugcccaguaccauccagacccucacgcuguuccugaccuccggcggggugcuccugagccuguacgucuccgccagccucuccuaccugcuguauucggacauccuccugaaguucaccccgaccgagaucacggcccccaccaugccccuggacugcgcgaacgccuccaaugugcaggccgugaaccgcagcgccaccaagggcgucacgccccuccugccggagcccgaguggaccuacccccggcuguccugccccgggagcaccuuucagaaggcccuccugaucuccccgcaccgcuucggcgagaccaaggggaacagcgcgccccugaucauccgggagcccuucaucgccugcggccccaaugagugcaagcacuucgcccucacccacuacgccgcgcagccgggcggguauuacaacggcacgcgcggggaccggaacaagcugcgccaccugaucuccgugaagcucggcaagauccccaccguggagaacaguaucuuccacauggccgccugguccgggagcgccugccacgauggcaaggaguggaccuacaucggcgucgacgggcccgacaacaacgcccugcugaagaucaaguacggcgaggcguauaccgacacguaccacuccuacgccaacaagauccuccggacccaggagagugccugcaacugcaucgggggcaacugcuaccugaugaucaccgauggcuccgccagcggggugucggagugccgcuuccugaagauccgggagggccgcaucaucaaggagaucuuccccaccgggcgggugaagcauacggaggagugcacgugcggcuucgccuccaacaagaccaucgagugcgcgugccgcgauaacagcuacaccgccaagcggccguucgucaagcucaacguggagaccgauaccgccgagauccgccugaugugcaccgacaccuaccuggacacgccccggcccgacgacggguccaucaccggccccugugagagcaacggcgacaagggguccggcgggaucaagggcggguucgugcaccagcgcauggccaguaagaucggccggugguacucccgcaccaugucgaagaccgagcggaugggcauggggcucuacgucaaguacgacggcgacccgugggccgauuccgacgcgcuggccuucagcggggugaugguguccaugaaggagcccggcugguacagcuuuggguucgagaucaaggacaagaagugcgacguccccugcaucggcaucgagauggugcacgauggcgggaaggagacguggcacuccgccgccaccgccaucuacugccugaugggcagcgggcagcuccugugggacaccgugaccggcgucgacauggcgcuguga

SEQ ID NO: 29495 - RNA, 1401 nt, Artificial Sequence
  derived and/or modified CDS sequence (AUadapt) from InfluenzaB__AGX19088__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuucagaaggcccugcugaucucgccccaccgcuucggcgagaccaaggggaacuccgcgccgcucaucauccgggagcccuucaucgccugcggccccaaugagugcaagcacuucgcccugacccacuacgccgcgcagcccggcggguauuacaacggcacccgcggggaccggaacaagcugcgccaccucaucagcgugaagcugggcaagaucccgacgguggagaauuccaucuuccacauggccgccuggagcggguccgccugccacgauggcaaggaguggaccuacaucggcgucgacgggcccgacaacaacgcccugcucaagaucaaguacggcgaggcguauaccgacaccuaccacagcuacgccaauaagauccugcggacgcaggaguccgccugcaacugcaucgggggcaacugcuaccugaugaucaccgauggcagcgccagcgggguguccgagugccgcuuccucaagauccgggagggccgcaucgugaaggagaucuuccccaccgggcgggucaagcauaccgaggagugcacgugcggcuucgccucgaacaagaccaucgagugcgcgugucgcgacaacuccuacaccgccaagcggcccuucgugaagcugaacguggagaccgauacggccgagauccgccugaugugcaccgacaccuaccucgacaccccgcggcccgacgacgggaguaucacgggccccugcgaguccaacggcgacaaggggagcggcgggaucaagggcggguucguccaucagcgcauggccuccaagaucggccggugguacagccgcaccauguccaagaccgagcggaugggcauggggcuguacgugaaguacgacggcgaccccugggccgauagcgacgcgcuggccuucuccggggugauggucagcaugaaggagccgggcugguacuccuuuggguucgagaucaaggacaagaagugcgacgugcccugcaucggcaucgagauggugcacgauggcgggaaggagaccuggcacagcgccgccacggccaucuacugccucaugggcuccgggcagcugcugugggacaccgucaccggcguggacauggcgcucuga

SEQ ID NO: 29496 - RNA, 1401 nt, Artificial Sequence; identical to SEQ ID NO: 28748
  derived and/or modified CDS sequence (AUadapt) from InfluenzaB__AGX19099__NA

SEQ ID NO: 29497 - RNA, 1401 nt, Artificial Sequence
  derived and/or modified CDS sequence (AUadapt) from InfluenzaB__AGX19110__NA
augcugcccaguaccauccagacccucacgcuguuccugaccuccggcggggugcuccugagccuguacgucuccgccagccucuccuaccugcuguacucggauauccuccugaaguucccguccaccgagaucaccgcccccacgaugccccuggacugcgcgaacgccagcaacgugcaggccgugaaccgcuccgccaccaagggcgucacccuccugcugcccgagccggaguggaccuauccccggcucagcugccccggguccacguuccagaaggcccugcugaucucgccccaccgcuucggcgagaccaaggggaacuccgcgccgcucaucauccgggagcccuuuaucgccugcggccccaaggagugcaagcacuucgcccugacccacuacgccgcgcagcccggcggguacuauaacggcacccgcggggaccggaacaagcugcgccaccucaucagcgugaagcugggcaagaucccgacgguggagaacuccaucuuccacauggccgccuggaguggguccgccugccacgacggcaaggaguggaccuacaucggcgucgacgggcccgacaacaaugcccugcucaagaucaaguacggcgaggcguacaccgacaccuaccacucguacgccaauaacauccugcggacgcaggaguccgccugcaacugcaucgggggcaacugcuaccugaugaucaccgauggcagcgccagcgggguguccgagugccgcuuccucaagauccgggagggccgcaucaucaaggagaucuuccccaccgggcggaucaagcacaccgaggagugcacguguggcuucgccucgaacaagaccaucgagugcgcgugccgcgacaacuccuacaccgccaagcggcccuuuaucaagcugaacguggagaccgacacggccgagauccgccugaugugcaccgagaccuaccucgacaccccgcggcccgacgacgggaguaucacgggccccugcgaguccaacggcgacaaggggagcggcgggaucaagggcggguucguccaccagcgcauggccuccaagaucggccggugguacagucgcaccauguccaagaccgagcggaugggcauggggcuguacgugaaguacgacggcgaccccugggccgacagcgacgcgcugguguuuuccggggucauggugagcauggaggagccgggcugguacuccuucggguucgagaucaaggacaagaagugcgacgugcccuguaucggcaucgagaugguccacgacggcgggaaggagaccuggcacagcgccgccacggccaucuacugccucaugggcuccgggcagcugcugugggacaccgugaccggcgugaacauggcccucuga

SEQ ID NO: 29498 - RNA, 1401 nt, Artificial Sequence
  derived and/or modified CDS sequence (AUadapt) from InfluenzaB__AGX19121__NA
augcugcccaguaccacccagacgcucacccuguuccugaccuccggcggggugcuccugagccuguacgucuccgccagccucuccuaccugcuguauagcgacauccuccugaaguucuccccgaccgagaucacggcccccaccaugccccuggacugcgcgaaugccucgaacgugcaggccgugaaccgcuccgccaccaagggcgucacccuccugcugcccgagccggaguggacguacccccggcucagcugucccggguccaccuuccagaaggcccugcugaucagcccccaccgcuucggcgagaccaaggggaacuccgcgccgcucaucauccgggagcccuuuaucgccugcggccccaacgagugcaagcacuucgcccugacccacuaugccgcgcagcccggcggguacuacaacggcacgcgcggggaccggaacaagcugcgccaucucaucagcgugaagcugggcaagaucccgaccguggagaacuccaucuuccacauggccgccuggagcggguccgccugucacgacggcaaggaguggaccuacaucggcgucgacgggcccgacaauaacgcccugcucaagaucaaguacggcgaggcguacaccgacacguaccauucguacgccaacaagauccugcggacccaggaguccgccugcaacugcaucgggggcaauugcuaccugaugaucaccgacggcagcgccagcgggguguccgagugucgcuuccucaagauccgggagggccgcaucaucaaggagaucuuccccaccgggcgggugaagcacacggaggagugcacgugcggcuuugccagcaacaagaccaucgagugcgcgugccgcgacaauuccuacaccgccaagcggcccuucgucaagcugaacguggagaccgacaccgccgagauccgccugaugugcaccgauaccuaccucgacacgccgcggcccgacgacgggagcaucaccggccccugcgaguccaauggcgacaaggggucgggcgggaucaagggcggguucgugcaccagcgcauggccuccaagaucggccggugguacagucgcaccauguccaagaccgagcggaugggcauggggcuguacgucaaguacgacggcgaccccugggccgacagugacgcgcuggccuuccgcggggugaugguguccaugaaggagccgggcugguacagcuucggguuugagaucaaggacaagaagugcgacguccccugcaucggcaucgagauggugcacgauggcgggaaggagacguggcacuccgccgccaccgccaucuacugccucaugggcagcgggcagcugcugugggacaccgugaccggcgucgacauggcgcucuga

SEQ ID NO: 29499 - RNA, 1401 nt, Artificial Sequence; identical to SEQ ID NO: 29382
  derived and/or modified CDS sequence (AUadapt) from InfluenzaB__AGX19132__NA

SEQ ID NO: 29500 - RNA, 1401 nt, Artificial Sequence; identical to SEQ ID NO: 29486
  derived and/or modified CDS sequence (AUadapt) from InfluenzaB__AGX19143__NA

SEQ ID NO: 29501 - RNA, 1401 nt, Artificial Sequence
  derived and/or modified CDS sequence (AUadapt) from InfluenzaB__AGX19154__NA
augcugcccaguaccauccagacccucacgcuguuccugaccuccggcggggugcuccugagccuguacgucuccgccagccucuccuaccugcuguacaguaacauccuccugaaguucuccccgaccgagaucaccgcccccacgaugccccuggacugcgcgaacgccagcaaugugcacgccgugaaccgcuccgccaccaagggcgucacccuccugcugcccgagccggaguggaccuacccccggcucagcugccccggguccacguuccagaaggcccugcugaucagcccccaucgcuucggcgagaccaaggggaacuccgcgccgcucaucauccgggagcccuucaucgccugcggccccaacgagugcaagcauuucgcccugacccacuacgccgcgcagcccggcggguacuacaacggcacccgcggggaccggaauaagcugcgccaccucaucucggugaagcugggcaagaucccgacgguggagaacuccaucuuccacauggccgccuggagcggguccgccugucacgacggcaaggaguggaccuacaucggcgucgacgggcccgacaacaaugcccugcucaagaucaaguacggcgaggcguacaccgacaccuaccacagcuacgccaauaacauccugcggacgcaggaguccgccugcaacugcaucgggggcaacugcuaucugaugaucaccgacggcagcgccucggggguguccgagugccgcuuccucaagauccgggagggccgcaucaucaaggagaucuuccccaccgggcgggugaagcacaccgaggaguguacgugcggcuucgccagcaacaagaccaucgagugcgcgugccgcgauaacuccuacaccgccaagcggcccuucgucaagcugaacguggagaccgacacggccgagauccgccugaugugcaccgauaccuaccucgacaccccgcggcccgacgacgggagcaucacgggccccugcgaguccaacggcgauaaggggagcggcgggaucaagggcggguucgugcaccagcgcauggccuccaagaucggccggugguacucgcgcaccauguccaagaccgagcggaugggcauggggcuguacgucaaguaugacggcgaccccugggccgacagcgacgcgcuggccuucuccggggugauggugagcaugaaggagccgggcugguauuccuucggguucgagaucaaggacaagaagugcgacguccccugcaucggcaucgagauggugcaugacggcgggaaggagaccuggcacagcgccgccacggccaucuacugccucaugggcuccgggcagcugcugugggacaccgugaccggcgucgacauggcgcucuga

SEQ ID NO: 29502 - RNA, 1401 nt, Artificial Sequence; identical to SEQ ID NO: 28748
  derived and/or modified CDS sequence (AUadapt) from InfluenzaB__AGX19165__NA

SEQ ID NO: 29503 - RNA, 1401 nt, Artificial Sequence
  derived and/or modified CDS sequence (AUadapt) from InfluenzaB__AGX19176__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccucgaaugugcacgccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaacgaguguaagcacuucgcccugacccacuacgccgcgcagcccggcggguacuacaaucgcacccggggcgaccgcaacaagcugcggcaccucaucagcgugaagcuggggaagaucccgacgguggagaacuccaucuuccauauggccgccuggagcggcuccgccugccacgacgggaaggaguggaccuacaucggcgucgacggccccgauaacaacgcccugcucaagaucaaguacggggaggcguacaccgacaccuaccauucguacgccaacaacauccugcgcacgcaggaguccgccugcaacuguaucggcgggaacugcuaccugaugaucaccgacggcagcgccagcggcguguccgagugucgguuccucaagauccgcgaggggcggaucaucaaggagaucuuccccaccggccgcgugaagcacaccgaggagugcacgugcggguucgccaguaacaagaccaucgagugcgcgugccgggacaacuccuacaccgccaagcgccccuuugucaagcugaacguggagaccgacacggccgagauccggcugaugugcaccgacaccuaccucgacaccccgcgccccgaugacggcagcaucacggggcccugcgaguccaacggcgacaagggcucggggggcaucaagggcggguuugugcaccagcggauggccuccaagaucgggcgcugguacagccggaccauguccaagaccgagcgcaugggcaugggccuguacgucaaguacgacggggaucccugggccgacagcgacgcgcuggccuucuccggcgugauggugagcaugaaggagccggggugguacuccuuuggcuucgagaucaaggacaagaagugcgacguccccugcaucgggaucgagauggugcacgauggcggcaaggagaccuggcacagcgccgccacggccaucuacugccucaugggguccggccagcugcugugggacaccgugaccggggucgacauggcgcucuga

SEQ ID NO: 29504 - RNA, 1401 nt, Artificial Sequence
  derived and/or modified CDS sequence (AUadapt) from InfluenzaB__AGX19187__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccucgaaugugcaggccgugaaccgcuccgccaccaagggcgucacccuccugcugcccgagccggaguggaccuacccccggcucagcugcuccgggagcacguuccagaaggcccugcugaucagcccccaucgcuucggcgagaccaaggggaacuccgcgccccucaucauccgggagccguucaucgccugcggccccaacgagugcaagcauuucgcccugacccacuacgccgcgcagcccggcggguacuacaacggcacccgcggggaucggaacaagcugcgccaccucaucuccgugaagcugggcaagauccccacgguggagaacucgaucuuccacauggccgccugguccgggagcgccugucacgacggcaaggaguggaccuacaucggcgucgacgggccggacaacaaugcccugcucaagaucaaguacggcgaggcguacaccgacaccuaccacuccuacgccaauaagauccugcggacgcaggagagcgccugcaacugcaucgggggcaacugcuaccugaugaucaccgauggcagcgccuccggggugucggagugccgcuuccucaagauccgggagggccgcaucaucaaggagaucuuccccaccgggcgggugaagcacaccgaggaguguacgugcggcuucgccuccaacaagaccaucgagugcgcgugccgcgacaauagcuacaccgccaagcggcccuucgucaagcugaacguggagaccgacacggccgagauccgccugaugugcaccgacaccuaucucgacacgccccggccggacgacggguccaucaccggccccugcgagagcaacggcgauaagggguccggcgggaucaagggcggguucgugcaccagcgcauggccagcaagaucggccggugguacucccgcaccaugucgaagaccgagcggaugggcauggggcuguacgucaaguaugacggcgaccccugggccgacuccgacgcgcuggccuucagcggggugaugguguccaugaaggagcccggcugguacaguuucggguucgagaucaaggacaagaagugcgacgucccgugcaucggcaucgagauggugcaugacggcgggaaggagaccuggcacuccgccgccacggccaucuacugccucaugggcagcgggcagcugcugugggacaccgugaccggcgucgacauggcgcucuga

SEQ ID NO: 29505 - RNA, 1401 nt, Artificial Sequence
  derived and/or modified CDS sequence (AUadapt) from InfluenzaB__AGX19198__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacuacgcgaacgccagcaaugugcaggccgugaaccgcuccgccaccaagggcgucacccuccugcugcccgagccggaguggaccuacccccggcucagcugccccggguccacguuccagaaggcccugcugaucagcccccaucgcuucggcgagaccaaggggaacuccgcgccgcucaucauccgggagcccuucaucgccugcggccccaacgagugcaagcacuuugcccugacccacuacgccgcgcagcccggcggguacuacaacggcacccgcggggaccggaauaagcugcgccaccucaucucggugaagcugggcaagaucccgacgguggagaacuccaucuuccacauggccgccuggagcggguccgccugucacgacggcaaggaguggaccuacaucggcgucgacgggcccgacaacaacgcccugcucaagaucaaguauggcgaggcguacaccgacaccuaccacagcuacgccaauaagauccugcggacgcaggaguccgccugcaacugcaucgggggcaacugcuaccugaugaucaccgauggcagcgccucggggguguccgagugccgcuuccucaagauccgggagggccgcaucaucaaggagaucuuccccaccgggcgggugaagcacaccgaggaguguacgugcggcuucgccagcaacaagaccaucgagugcgcgugccgcgacaauuccuacaccgccaagcggcccuucgucaagcugaacguggagaccgacacggccgagauccgccugaugugcaccgacaccuaucucgacaccccgcggcccgacgacgggagcaucacgggccccugcgaguccaacggcgauaaggggagcggcgggaucaagggcggguucgugcaccagcgcauggccuccaagaucggccggugguacucgcgcaccauguccaagaccgagcggaugggcauggggcuguacgucaaguacgauggcgaccccugggccgacagcgacgcgcuggccuucuccggggugauggugagcaugaaggagccgggcugguauuccuucggguucgagaucaaggacaagaagugcgacguccccugcaucggcaucgagauggugcaugacggcgggaaggagaccuggcacagcgccgccacggccaucuacugccucaugggcuccgggcagcugcugugggacaccgugaccggcgucgacauggcgcucuga

SEQ ID NO: 29506 - RNA, 1401 nt, Artificial Sequence; identical to SEQ ID NO: 29486
  derived and/or modified CDS sequence (AUadapt) from InfluenzaB__AGX19209__NA

SEQ ID NO: 29507 - RNA, 1401 nt, Artificial Sequence
  derived and/or modified CDS sequence (AUadapt) from InfluenzaB__AGX19220__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugagccuggacugcgcgaaugccuccaacgugcaggccgugaaccgcagcgccaccaagggcgucacccuccugcugcccgagcccgaguggaccuacccgcggcucuccugccccgggaguacguuccagaaggcccugcugaucagcccccaccgcuucggcgagaccaaggggaacuccgcgccccucaucauccgggagccguucaucgccuguggccccaacgagugcaagcacuucgcccugacccacuaugccgcgcagcccggcggguacuacaacggcacccgcggggaccggaacaagcugcgccaccucaucuccgugaagcugggcaagauccccacgguggagaauagcaucuuccacauggccgccugguccgggagcgccugccacgauggcaaggaguggaccuacaucggcgucgacgggccggacaacaacgcccugcucaagaucaaguauggcgaggcguacaccgacaccuaccacuccuacgccaacaagauccugcggacgcaggagagugccugcaacugcaucgggggcaacugcuaucugaugaucaccgacggcagcgccuccggggugagcgagugccgcuuccucaagauccgggagggccgcaucaucaaggagaucuuccccaccgggcgggugaagcauaccgaggagugcacgugcggcuucgccuccaacaagaccaucgagugcgcgugucgcgacaacucguacaccgccaagcggcccuucgucaagcugaacguggagaccgauacggccgagauccgccugaugugcaccgacaccuaccucgacacgccccggccggacgacggguccaucaccggccccugugagagcaacggcgaccgcggguccggcgggaucaagggcggguucgugcaccagcggauggccaguaagaucggccgcugguacucccggaccaugagcaagaccgagcgcaugggcauggggcuguacgucaaguacgacggcgaccccugggccgauuccgacgcgcuggccuucagcggggugaugguguccaugaaggagcccggcugguacagcuuuggguucgagaucaaggacaagaagugcgacgucccgugcaucggcaucgagauggugcacgauggcgggaaggagaccuggcacuccgccgccacggccaucuacugccucaugggcagcgggcagcugcugugggacaccgugaccggcgucgacauggcgcucuga

SEQ ID NO: 29508 - RNA, 1401 nt, Artificial Sequence; identical to SEQ ID NO: 28954
  derived and/or modified CDS sequence (AUadapt) from InfluenzaB__AGX19231__NA

SEQ ID NO: 29509 - RNA, 1401 nt, Artificial Sequence
  derived and/or modified CDS sequence (AUadapt) from InfluenzaB__AGX19253__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaacgugcaggccgugaaucacuccgccaccaagggcgucacccuccugcugcccgagccggaguggaccuacccccgccucagcugccccggguccacguuccagaaggcccugcugaucucgccccaccgguuuggcgagaccaaggggaacuccgcgccgcucaucauccgcgagcccuucaucgccugcggccccaacgagugcaagcacuucgcccugacccauuacgccgcgcagcccggcggguacuacaacggcacccgcggggaccggaacaagcugcggcaccucaucagugugaagcugggcaagaucccgacgguggagaacuccaucuuccacauggccgccuggagcggguccgccugccacgacggcaaggaguggaccuauaucggcgucgacgggcccgacaacaacgcccugcucaagaucaaguacggcgaggcguacaccgacaccuaucacagcuacgccaacaagauccugcgcacgcaggaguccgccugcaacugcaucgggggcaauugcuaccugaugaucaccgacggcucggccagcgggguguccgagugccgguuucucaagauccgcgagggccggaucaucaaggagaucuuccccaccgggcgcgugaagcacaccgaggagugcacgugcggcuucgccagcaacaagaccaucgagugugcgugccgggacaacuccuacaccgccaagcgccccuucgucaagcugaacguggagaccgacacggccgagauccggcugauguguaccgacaccuaccucgacaccccgcgccccgacgacgggucgaucacgggccccugcgaguccaauggcgacaaggggagcggcgggaucaagggcggguucgugcaccagcggauggccuccaagaucggccgcugguacagccggaccauguccaagaccgagcgcaugggcauggggcuguacgucaaguaugacggcgaccccugggccgacucggacucccuggcguucagcggggugaugguguccaugaaggagccgggcugguauagcuucggguucgagaucaaggacaagaagugcgacguccccugcaucggcaucgagauggugcaugacggcgggaaggagaccuggcacuccgccgccacggccaucuacugccucaugggcagcgggcagcugcugugggacaccgugaccggcgucgacauggcccucuga

SEQ ID NO: 29510 - RNA, 1401 nt, Artificial Sequence; identical to SEQ ID NO: 29484
  derived and/or modified CDS sequence (AUadapt) from InfluenzaB__AGX19264__NA

SEQ ID NO: 29511 - RNA, 1401 nt, Artificial Sequence; identical to SEQ ID NO: 28748
  derived and/or modified CDS sequence (AUadapt) from InfluenzaB__AGX19275__NA

SEQ ID NO: 29512 - RNA, 1401 nt, Artificial Sequence
  derived and/or modified CDS sequence (AUadapt) from InfluenzaB__AGX19286__NA
augauccccaguaccauccagacccugacccucuuccugaccuccggcggggugcugcucagccuguacgucuccgccagccuguccuaccuccuguacagugacauccugcucaaguucuccccgaccgagaucaucgcccccaccaugccccuggacugcgcgaacgccagcaacgugcaugccgugaaccgcuccgccacgaagggcgucacccugcuccugcccgagccggaguggaccuacccccggcugagcugccccggguccaccuuccagaaggcccuccugaucagcccccaccgcuuuggcgagacgaaggggaacuccgcgccgcugaucauccgggagcccuucaucgccugcggccccaacgagugcaagcacuucgcccucacccauuacgccgcgcagcccggcggguacuacaacggcacccgcggggaccggaacaagcugcgccaccugaucagugugaagcucggcaagaucccgaccguggagaacuccaucuuccacauggccgccuggagcggguccgccugccacgacggcaaggaguggacguauaucggcgucgacgggcccgacaacaacgcccugcugaagaucaaguacggcgaggcguacaccgacaccuaucacagcuacgccaacaacauccuccggacccaggaguccgccugcaacuguaucgggggcaacugcuaccugaugaucacggacggcagcgccucggggguguccgagugucgcuuccugaagauccgggagggccgcaucaucaaggagaucuuccccaccgggcgggugaagcacaccgaggagugcacgugcggcuucgccagcaauaagacgaucgagugcgcgugccgcgacaacuccuacaccgccaagcggcccuucgucaagcucaacguggagaccgauaccgccgagauccgccugaugugcacggacaccuaccuggacaccccgcggcccgacgacgggagcaucaccggccccugugaguccaacggcgacaaggggagcggcgggaucaagggcggguucgugcaccagcgcauggccuccaagaucggccggugguacucgcgcacgauguccaagaccgagcggaugggcauggggcucuaugucaaguacgacggcgaccccugggccgacagcgacgcgcuggccuucuccggggugauggugaguaugaaggagccgggcugguacuccuucggguucgagaucaaggacaagaagugcgacguccccugcaucggcaucgagauggugcaugacggcgggaaggagaccuggcacagcgccgccaccgccaucuacugccugaugggcuccgggcagcuccugugggacacggugaccggcgucgacauggcgcuguga

SEQ ID NO: 29513 - RNA, 1401 nt, Artificial Sequence
  derived and/or modified CDS sequence (AUadapt) from InfluenzaB__AGX19297__NA
augcugcccaguaccauccagacccucacgcuguuccugaccuccggcggggugcuccugagccuguacgucuccgccagccucuccuaccugcuguacagugacauccuccugaaguucuccccgaccgagaucaucgcccccaccaugccccuggacugcgcgaacgccucgaaugugcacgccgugaaccgcuccgccacgaagggcgucacccuccugcugcccgagccggaguggaccuacccccggcucagcugccccggguccaccuuccagaaggcccugcugaucagcccccaucgcuucggcgagacgaaggggaacuccgcgccgcucaucauccgggagcccuucaucgccugcggccccaacgagugcaagcauuucgcccugacccacuacgccgcgcagcccggcggguacuacaacggcacccgcggggaccggaauaagcugcgccaccucaucagcgugaagcugggcaagaucccgaccguggagaacuccaucuuccacauggccgccuggagcggguccgccugucacgacggcaaggaguggacguacaucggcgucgacgggcccgacaacaaugcccugcucaagaucaaguacggcgaggcguacaccgacaccuaccacucguacgccaauaacauccugcggacccaggaguccgccugcaacugcaucgggggcaacugcuaucugaugaucacggacggcagcgccagcgggguguccgagugccgcuuccucaagauccgggagggccgcaucaucaaggagaucuuccccaccgggcgggugaagcacaccgaggaguguacgugcggcuucgccagcaacaagaccaucgagugcgcgugccgcgauaacuccuacaccgccaagcggcccuucgucaagcugaacguggagaccgacaccgccgagauccgccugaugugcacggauaccuaccucgacaccccgcggcccgacgacgggagcaucaccggccccugcgaguccaacggcgauaaggggucgggcgggaucaagggcggguucgugcaccagcgcauggccuccaagaucggccggugguacagccgcacgauguccaagaccgagcggaugggcauggggcuguacgucaaguaugacggcgaccccugggccgacagcgacgcgcuggccuucuccggggugauggugagcaugaaggagccgggcugguauuccuucggguucgagaucaaggacaagaagugcgacguccccugcaucggcaucgagauggugcaugacggcgggaaggagaccuggcacagcgccgccaccgccaucuacugccucaugggcuccgggcagcugcugugggacacggugaccggcgucgacauggcgcucuga

SEQ ID NO: 29514 - RNA, 1401 nt, Artificial Sequence; identical to SEQ ID NO: 29513
  derived and/or modified CDS sequence (AUadapt) from InfluenzaB__AGX19308__NA

SEQ ID NO: 29515 - RNA, 1401 nt, Artificial Sequence; identical to SEQ ID NO: 29513
  derived and/or modified CDS sequence (AUadapt) from InfluenzaB__AGX19319__NA

SEQ ID NO: 29516 - RNA, 1401 nt, Artificial Sequence
  derived and/or modified CDS sequence (AUadapt) from InfluenzaB__AGX19330__NA
augcugcccaguaccauccagacccucacgcuguuccugaccuccggcggggugcuccugagccuguacgucuccgccagccucuccuaccugcuguacagugacauccuccugaaguucuccccgaccgagaucaucgcccccaccaugccccuggacugcgcgaacgccagcaacgugcaugccgugaaccgcuccgccacgaagggcgucacccuccugcugcccgagccggaguggaccuacccccggcucagcugccccggguccaccuuccagaaggcccugcugaucagcccccaccgcuuuggcgagacgaaggggaacuccgcgccgcucaucauccgggagcccuucaucgccugcggccccaacgagugcaagcacuucgcccugacccauuacgccgcgcagcccggcggguacuacaacggcacccgcgggaaccggaacaagcugcgccaccucaucagugugaagcugggcaagaucccgaccguggagaacuccaucuuccacauggccgccuggagcggguccgccugccacgacggcaaggaguggacguauaucggcgucgacgggcccgacaacaacgcccugcucaagaucaaguacggcgaggcguacaccgacaccuaucacagcuacgccaacaacauccugcggacccaggaguccgccugcaacuguaucgggggcaacugcuaccugaugaucacggacggcagcgccucggggguguccgagugucgcuuccucaagauccgggagggccgcaucaucaaggagaucuuccccaccgggcgggugaagcacaccgaggagugcacgugcggcuucgccagcaauaagaccaucgagugcgcgugccgcgacaacuccuacaccgccaagcggcccuucgucaagcugaacguggagaccgauaccgccgagauccgccugaugugcacggacaccuaccucgacaccccgcggcccgacgacgggagcaucaccggccccugugaguccaacggcgacaaggggagcggcgggaucaagggcggguucgugcaccagcgcauggccuccaagaucggccggugguacucgcgcacgauguccaagaccgagcggaugggcauggggcuguaugucaaguacgacggcgaccccugggccgacagcgacgcgcuggccuucuccggggugauggugaguaugaaggagccgggcugguacuccuucggguucgagaucaaggacaagaagugcgacguccccugcaucggcaucgagauggugcaugacggcgggaaggagaccuggcacagcgccgccaccgccaucuacugccucaugggcuccgggcagcugcugugggacacggugaccggcgucgacauggcgcucuga

SEQ ID NO: 29517 - RNA, 1401 nt, Artificial Sequence; identical to SEQ ID NO: 29513
  derived and/or modified CDS sequence (AUadapt) from InfluenzaB__AGX19341__NA

SEQ ID NO: 29518 - RNA, 1401 nt, Artificial Sequence; identical to SEQ ID NO: 29513
  derived and/or modified CDS sequence (AUadapt) from InfluenzaB__AGX19352__NA

SEQ ID NO: 29519 - RNA, 1401 nt, Artificial Sequence
  derived and/or modified CDS sequence (AUadapt) from InfluenzaB__AGX19363__NA
augcugcccaguaccauccagacccucacgcuguuccugaccuccggcggggugcuccugagccuguacgucuccgccagccucuccuaccugcuguacagugacauccuccugaaguucuccccgaccgagaucaucgcccccaccaugccccuggacugcgcgaacgccucgaacgugcaugccgugaaccgcuccgccacgaagggcgucacccuccugcugcccgagccggaguggaccuacccccggcucagcugccccggguccaccuuccagaaggcccugcugaucagcccccaccgcuuuggcgagacgaaggggaacuccgcgccgcucaucauccgggagcccuucaucgccugcggccccaacgagugcaagcacuucgcccugaccuauuacgccgcgcagcccggcggguacuacaacggcacccgcggggaccggaacaagcugcgccaccucaucagugugaagcugggcaagaucccgaccguggagaacuccaucuuccacauggccgccuggagcggguccgccugccacgacggcaaggaguggacguauaucggcgucgacgggcccgacaacaacgcccugcucaagaucaaguacggcgaggcguacaccgacaccuaucacucguacgccaacaacauccugcggacccaggaguccgccugcaacuguaucgggggcaacugcuaccugaugaucacggacggcagcgccagcgggguguccgagugucgcuuccucaagauccgggagggccgcaucaucaaggagaucuuccccaccgggcgggugaagcacaccgaggagugcacgugcggcuucgccagcaauaagaccaucgagugcgcgugccgcgacaacuccuacaccgccaagcggcccuucgucaagcugaacguggagaccgauaccgccgagauccgccugaugugcacggacaccuaccucgacaccccgcggcccgacgacgggagcaucaccggccccugugaguccaacggcgacaaggggucgggcgggaucaagggcggguucgugcaccagcgcauggccuccaagaucggccggugguacagccgcacgauguccaagaccgagcggaugggcauggggcuguaugucaaguacgacggcgaccccugggccgacagcgacgcgcuggccuucuccggggugauggugaguaugaaggagccgggcugguacuccuucggguucgagaucaaggacaagaagugcgacguccccugcaucggcaucgagauggugcaugacggcgggaaggagaccuggcacagcgccgccaccgccaucuacugccucaugggcuccgggcagcugcugugggacacggugaccggcgucgacauggcgcucuga

SEQ ID NO: 29520 - RNA, 1401 nt, Artificial Sequence
  derived and/or modified CDS sequence (AUadapt) from InfluenzaB__AGX19374__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaaugccagcaacgugcaggccgugaaccgcuccgccgccaagggcgucacgcuccugcugagcgagcccgaguggaccuacccccggcucuccuguccggggucgaccuuccagaaggcgcugcugaucagcccccaccgcuucggcgagaccaaggggaacuccgcgccccucaucauccgggagcccuuuaucgccugcggcccgacggagugcaagcacuucgcccugacccacuaugccgcccagcccggcggguacuacaacggcacccgcgaggaccggaacaagcugcgccaucucaucuccgugaagcuggggaagauccccaccguggagaacagcaucuuccacauggccgccugguccggcagcgccugccaugacgggaaggaguggacguacaucggcgucgacggccccgacuccaacgcgcugcucaagaucaaguauggggaggccuacaccgacaccuaccacagcuaugccaagaacauccugcggacccaggagagcgccugcaacugcaucggcggggacuguuaccugaugaucacggacggcccggccuccggcgugagcgagugccgcuuccucaagauccgggaggggcgcaucaucaaggagaucuuucccaccggccgggugaagcacaccgaggagugcacgugcggguucgcguccaacaagaccaucgagugugccugccgcgacaacucguacaccgccaagcggcccuucgucaagcugaauguggagaccgacaccgccgagauccgccugaugugcacggagaccuaccucgacacgccccggccgaacgauggcuccaucaccgggcccugcgagagcgacggcgacaagggcuccgggggcaucaagggcggguucgugcaucagcgcauggccagcaagaucgggcggugguacucccgcaccaugagcaagaccaagcggaugggcaugggccuguacgucaaguacgacggggaucccuggaccgacuccgaggcgcuggcccucagcggcgugaugguguccauggaggagcccgggugguacagcuucggcuuugagaucaaggacaagaagugcgacgucccgugcaucgggaucgagauggugcacgauggcggcaagaccacguggcacuccgccgccaccgccaucuacugccugauggggagcggccagcugcucugggacaccgugaccggggucgacauggcgcuguga

SEQ ID NO: 29521 - RNA, 1401 nt, Artificial Sequence; identical to SEQ ID NO: 29513
  derived and/or modified CDS sequence (AUadapt) from InfluenzaB__AGX19385__NA

SEQ ID NO: 29522 - RNA, 1401 nt, Artificial Sequence
  derived and/or modified CDS sequence (AUadapt) from InfluenzaB__AGX19396__NA
augcugcccaguaccauccagacccucacgcuguuccugaccuccggcggggugcuccugagccuguacgucuccgccagccucuccuaccugcuguacagugacauccuccugaaguucuccccgaccgagaucaucgcccccaccaugccccuggacugcgcgaacgccagcaaugugcacgccgugaaccgcuccgccacgaagggcgucacccuccugcugcccgagccggaguggaccuacccccggcucagcugccccggguccaccuuccagaaggcccugcugaucaguccccaccgcuucggcgagacgaaggggaacuccgcgccgcucaucauccgggagcccuucaucgccugcggccccaacgaguguaagcacuucgcccugacccacuacgccgcgcagcccggcggguacuacaauggcccgcgcggggaccggaacaagcugcgccaccucaucagcgugaagcugggcaagauccccaccguggagaacuccaucuuccauauggccgccuggagcggguccgccugccacgacggcaaggaguggaccuacaucggcgucgacgggcccgauaacaacgcccugcucaagaucaaguacggcgaggcguacacggacaccuaccauagcuacgccaacaacauccugcggacccaggaguccgccugcaacuguaucgggggcaacugcuaccugaugaucaccgacggcagcgccagcgggguguccgagugucgcuuccucaagauccgggagggccgcaucaucaaggagaucuuccccacggggcgggugaagcacaccgaggagugcacgugcggcuucgccaguaacaagaccaucgagugcgcgugccgcgacaacuccuacaccgccaagcggccguuugucaagcugaacguggagaccgacaccgccgagauccgccugaugugcaccgacacguaccucgacacgccccggcccgaugacgggagcaucaccggccccugcgaguccaacggcgacaaggggagcggcgggaucaagggcggguuugugcaccagcgcauggccuccaagaucggccggugguacagccgcaccauguccaagaccgagcggaugggcauggggcuguacgucaaguacgacggcgauccgugggccgacagcgacgcgcuggccuucuccggggugauggugagcaugaaggagcccggcugguacuccuuuggguucgagaucaaggacaagaagugcgacguccccugcaucggcaucgagauggugcacgauggcgggaaggagaccuggcacagcgccgccaccgccaucuacugccucaugggcuccgggcagcugcugugggacaccgugacgggcgucgacauggcgcucuga

SEQ ID NO: 29523 - RNA, 1401 nt, Artificial Sequence; identical to SEQ ID NO: 29513
  derived and/or modified CDS sequence (AUadapt) from InfluenzaB__AGX19407__NA

SEQ ID NO: 29524 - RNA, 1401 nt, Artificial Sequence; identical to SEQ ID NO: 28640
  derived and/or modified CDS sequence (AUadapt) from InfluenzaB__AGX19418__NA

SEQ ID NO: 29525 - RNA, 1401 nt, Artificial Sequence
  derived and/or modified CDS sequence (AUadapt) from InfluenzaB__AGX19429__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgaucaugccccuggacugugcgaacgccagcaacgugcaggccgugaaccgcuccgccgccaagggcgucacgcuccugcugcccgagcccgaguggaccuacccgcggcucaguugccccggguccaccuuccagaaggcgcugcugaucagcccccaccgcuuuggcgagaccaaggggaacuccgcgccccucaucauccgggagccguucaucgccugcggccccacggagugcaagcacuuugcccugacccacuacgccgcccagcccggcggguacuacaacggcacccgcgaggaucggaacaagcugcgccaccucaucagcgugaagcuggggaagauccccaccguggagaacuccaucuuucacauggccgccuggagcggcuccgccugccacgacgggaaggaguggacguauaucggcgucgacggcccggacagcaacgcgcugcucaagaucaaguacggggaggccuauaccgacaccuaccacuccuacgccaagaauauccugcggacccaggagagcgccugcaacugcaucggcggggacuguuaccugaugaucacggacggccccgccagcggcaucuccgagugccgcuuccucaagauccgggaggggcgcaucaucaaggagaucuuucccaccggccgggugaagcacaccgaggagugcacgugcggguucgcgaguaacaagaccaucgagugcgccugccgcgacaacuccuauaccgccaagcggcccuucgugaagcugaacgucgagaccgacaccgccgagauccgccugaugugcacggagaccuaccucgauaccccgcggcccaacgacggcagcaucaccgggcccugcgaguccgauggcgacaagggcagcgggggcaucaagggcggguucgugcaccagcgcauggccuccaagaucgggcggugguacagucgcacgauguccaagacccggcgcaugggcaugggccuguacgugaaguacgacggggaccccuggaccgacagugaggcgcuggcccucuccggcgucauggugagcauggaggagccggggugguacuccuucggcuucgagaucaaggauaagaagugcgacgugcccugcaucgggaucgagaugguccacgacggcggcaagaccacguggcauagcgccgccaccgccaucuacugccugaugggguccggccagcugcucugggacaccgugaccgggguggacauggcgcuguga

SEQ ID NO: 29526 - RNA, 1401 nt, Artificial Sequence
  derived and/or modified CDS sequence (AUadapt) from InfluenzaB__AGX19451__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccucgaaugugcacgccgugaaccacuccgccaccaagggcgucacccuccugcugcccgagccggaguggaccuacccccgccucagcugccccggguccacguuucagaaggcccugcugaucagcccccaccgguucggcgagaccaaggggaacuccgcgccgcucaucauccgcgagcccuucaucgccugcggccccaaugagugcaagcacuucgcccugacccacuacgccgcgcagcccggcggguacuauaacggcacccgcggggaccggaacaagcugcggcaccucaucagcgugaagcugggcaagaucccgacgguggagaacuccaucuuucacauggccgccuggagcggguccgccugccacgacggcaaggaguggaccuacaucggcgucgaugggcccgacaacaacgcccugcucaagaucaaguacggcgaggcguacaccgacaccuaucacucguacgccaacaacauccugcgcacgcaggaguccgccugcaauugcaucgggggcaacugcuaccugauggugaccgacggcagcgccagugggguguccgagugccgguuccucaagauccgcgagggccggaucaucaaggagaucuuccccaccgggcgcgucaagcacaccgaggagugcacgugcggcuuugccagcaacaagaccaucgagugcgcgugccgggacaacuccuauaccgccaagcgccccuucgugaagcugaacguggagaccgacacggccgagauccggcugaugugcaccgacaccuaccucgauaccccgcgccccgacgacgggagcaucacgggccccugcgaguccaacggcgacaaggggaguggcgggaucaagggcggguucguccaccagcggauggccuccaagaucggccgcugguacagccggaccauguccaagaccgagcgcaugggcauggggcuguacgugaaguacgauggcgaccccugggccgacagcgacgcgcuggccuucuccggggugauggucagcaugaaggagccgggcugguauuccuucggguucgagaucaaggacaagaagugcgacgugcccugcaucggcaucgagauggugcaugacggcgggaaggagaccuggcacagcgccgccacggccaucuacugccucaugggcuccgggcagcugcugugggacaccgucaccggcguggacauggcgcucuga

SEQ ID NO: 29527 - RNA, 1401 nt, Artificial Sequence; identical to SEQ ID NO: 29525
  derived and/or modified CDS sequence (AUadapt) from InfluenzaB__AGX19462__NA

SEQ ID NO: 29528 - RNA, 1401 nt, Artificial Sequence; identical to SEQ ID NO: 29525
  derived and/or modified CDS sequence (AUadapt) from InfluenzaB__AGX19473__NA

SEQ ID NO: 29529 - RNA, 1401 nt, Artificial Sequence; identical to SEQ ID NO: 28640
  derived and/or modified CDS sequence (AUadapt) from InfluenzaB__AGX19484__NA

SEQ ID NO: 29530 - RNA, 1401 nt, Artificial Sequence; identical to SEQ ID NO: 29526
  derived and/or modified CDS sequence (AUadapt) from InfluenzaB__AGX19495__NA

SEQ ID NO: 29531 - RNA, 1401 nt, Artificial Sequence; identical to SEQ ID NO: 28640
  derived and/or modified CDS sequence (AUadapt) from InfluenzaB__AGX19506__NA

SEQ ID NO: 29532 - RNA, 1401 nt, Artificial Sequence; identical to SEQ ID NO: 28640
  derived and/or modified CDS sequence (AUadapt) from InfluenzaB__AGX19517__NA

SEQ ID NO: 29533 - RNA, 1401 nt, Artificial Sequence; identical to SEQ ID NO: 28640
  derived and/or modified CDS sequence (AUadapt) from InfluenzaB__AGX19528__NA

SEQ ID NO: 29534 - RNA, 1401 nt, Artificial Sequence; identical to SEQ ID NO: 29526
  derived and/or modified CDS sequence (AUadapt) from InfluenzaB__AGX19539__NA

SEQ ID NO: 29535 - RNA, 1401 nt, Artificial Sequence
  derived and/or modified CDS sequence (AUadapt) from InfluenzaB__AGX19550__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccucgaaugugcacgccgugaaccacuccgccaccaagggcgucacccuccugcugcccgagccggaguggaccuacccccgccucagcugccccggguccacguuucagaaggcccugcugaucagcccccaccgguucggcgagaccaaggggaacuccgcgccgcucaucauccgcgagcccuucaucgccugcggccccaaugagugcaagcacuucgcccugacccacuacgccgcgcagcccggcggguacuauaacggcacccgcggggaccggaacaagcugcggcaccucaucagcgugaagcugggcaagaucccgacgguggagaacuccaucuuucacauggccgccuggagcggguccgccugccacgacggcaaggaguggaccuacaucggcgucgaugggcccgacaacaacgcccugcucaagaucaaguacggcgaggcguacaccgacaccuaucacucguacgccaacaacauccugcgcacgcaggaguccgccugcaacuguaucgggggcaacugcuaccugauggugaccgacggcagcgccagcgggguguccgagugucgguuccucaagauccgcgagggccggaucaucaaggagaucuuccccaccgggcgcgucaagcacaccgaggagugcacgugcggcuucgccaguaacaagaccaucgagugcgcgugccgggacaacuccuacaccgccaagcgccccuuugugaagcugaacguggagaccgacacggccgagauccggcugaugugcaccgacaccuaccucgacaccccgcgccccgaugacgggagcaucacgggccccugcgaguccaacggcgacaaggggucgggcgggaucaagggcggguuuguccaccagcggauggccuccaagaucggccgcugguacagccggaccauguccaagaccgagcgcaugggcauggggcuguacgugaaguacgacggcgaucccugggccgacagcgacgcgcuggccuucuccggggugauggucagcaugaacgagccgggcugguauuccuucggguucgagaucaaggacaagaagugcgacgugcccugcaucggcaucgagauggugcaugacggcgggaaggagaccuggcacagcgccgccacggccaucuacugccucaugggcuccgggcagcugcugugggacaccgucaccggcguggacauggcgcucuga

SEQ ID NO: 29536 - RNA, 1401 nt, Artificial Sequence
  derived and/or modified CDS sequence (AUadapt) from InfluenzaB__AGX19561__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccucgaaugugcacgccgugaaccacuccgccaccaagggcgucacccuccugcugcccgagccggaguggaccuacccccgccucagcugccccggguccacguuucagaaggcccugcugaucagcccccaccgguucggcgagaccaaggggaacuccgcgccgcucaucauccgcgagcccuucaucgccugcggccccaaugagugcaagcacuucgcccugacccacuacgccgcgcagccccggggcuacuauaacgggacccgcggcgaccggaacaagcugcgccaccucaucagcgugaagcuggggaagaucccgacgguggagaacuccaucuuucacauggccgccuggagcggcuccgccugccacgacgggaaggaguggaccuacaucggcgucgauggccccgacaacaacgcccugcucaagaucaaguacggggaggcguacaccgacaccuaucacucguacgccaacaacauccugcggacgcaggaguccgccugcaauugcaucggcgggaacugcuaccugauggugaccgacggcagcgccaguggcguguccgagugccgcuuccucaagauccgggaggggcgcaucaucaaggagaucuuccccaccggccgggucaagcacaccgaggagugcacgugcggguuugccagcaacaagaccaucgagugcgcgugccgcgacaacuccuauaccgccaagcggcccuucgugaagcugaacguggagaccgacacggccgagauccgccugaugugcaccgacaccuaccucgauaccccgcggcccgacgacggcagcaucacggggcccugcgaguccaacggcgacaagggcagugggggcaucaagggcggguucguccaccagcgcauggccuccaagaucgggcggugguacagccgcaccauguccaagaccgagcggaugggcaugggccuguacgugaaguacgauggggaccccugggccgacagcgacgcgcuggccuucuccggcgugauggucagcaugaaggagccggggugguauuccuucggcuucgagaucaaggacaagaagugcgacgugcccugcaucgggaucgagauggugcaugacggcggcaaggagaccuggcacagcgccgccacggccaucuacugccucaugggguccggccagcugcugugggacaccgucaccgggguggacauggcgcucuga

SEQ ID NO: 29537 - RNA, 1401 nt, Artificial Sequence
  derived and/or modified CDS sequence (AUadapt) from InfluenzaB__AGX19572__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaacgugcaggccgugaaucgcuccgccaccaagggcgucacccuccugcugcccgagccggaguggaccuacccccggcucagcugccccggguccacguuccagaaggcccugcugaucucgccccaccgcuucggcgagaccaaggggaauuccgcgccgcucaucauccgggagcccuucaucgccugcggccccaacgagugcaagcacuucgcccugacccacuaugccgcgcagcccggcggguacuacaacggcacccgcggggaccggaacaagcugcgccaccucaucagugugaagcugggcaagaucccgacgguggagaacuccaucuuccacauggccgccuggagcggguccgccugccacgacggcaaggaguggaccuauaucggcgucgacgggcccgacaacaacgcccugcucaaggugaaguacggcgaggcguacaccgacaccuaucacucguacgccaacaagauccugcggacgcaggaguccgccugcaacugcaucgggggcaauugcuaccugaugaucaccgacggcagcgccagcgggguguccgagugccgcuuucucaagauccgggagggccgcaucaucaaggagaucuuccccaccgggcgggucaagcacaccgaggagugcacgugcggcuucgccucgaacaagaccaucgagugugcgugccgcgacaacuccuacaccgccaagcggcccuucgugaagcugaacguggagaccgacacggccgagauccgccugauguguaccgacaccuaccucgacaccccgcggcccaacgacgggagcaucacgggccccugcgaguccaauggcgacaaggggagcggcgggaucaagggcggguucguccaccagcgcauggaguccaagaucggccggugguacucgcgcaccauguccaagaccgagcggaugggcauggggcuguaugugaaguacgacggcgaccccugggccgacagcgacgcccuggcguucuccggggugauggucaguaugaaggagccgggcugguacuccuucggguucgagaucaaggacaagaagugcgacgugcccugcaucggcaucgagauggugcaugacggcgggaaggagaccuggcacagcgccgccacggccaucuacugccucaugggcuccgggcagcugcugugggacaccgucaccggcgugaacauggcccucuga

SEQ ID NO: 29538 - RNA, 1401 nt, Artificial Sequence; identical to SEQ ID NO: 28640
  derived and/or modified CDS sequence (AUadapt) from InfluenzaB__AGX19583__NA

SEQ ID NO: 29539 - RNA, 1401 nt, Artificial Sequence; identical to SEQ ID NO: 28640
  derived and/or modified CDS sequence (AUadapt) from InfluenzaB__AGX19594__NA

SEQ ID NO: 29540 - RNA, 1401 nt, Artificial Sequence; identical to SEQ ID NO: 28640
  derived and/or modified CDS sequence (AUadapt) from InfluenzaB__AGX19605__NA

SEQ ID NO: 29541 - RNA, 1401 nt, Artificial Sequence; identical to SEQ ID NO: 28640
  derived and/or modified CDS sequence (AUadapt) from InfluenzaB__AGX19616__NA

SEQ ID NO: 29542 - RNA, 1401 nt, Artificial Sequence; identical to SEQ ID NO: 29526
  derived and/or modified CDS sequence (AUadapt) from InfluenzaB__AGX19627__NA

SEQ ID NO: 29543 - RNA, 1401 nt, Artificial Sequence; identical to SEQ ID NO: 28640
  derived and/or modified CDS sequence (AUadapt) from InfluenzaB__AGX19638__NA

SEQ ID NO: 29544 - RNA, 1401 nt, Artificial Sequence; identical to SEQ ID NO: 29526
  derived and/or modified CDS sequence (AUadapt) from InfluenzaB__AGX19649__NA

SEQ ID NO: 29545 - RNA, 1401 nt, Artificial Sequence; identical to SEQ ID NO: 29526
  derived and/or modified CDS sequence (AUadapt) from InfluenzaB__AGX19660__NA

SEQ ID NO: 29546 - RNA, 1401 nt, Artificial Sequence; identical to SEQ ID NO: 28640
  derived and/or modified CDS sequence (AUadapt) from InfluenzaB__AGX19671__NA

SEQ ID NO: 29547 - RNA, 1401 nt, Artificial Sequence; identical to SEQ ID NO: 28640
  derived and/or modified CDS sequence (AUadapt) from InfluenzaB__AGX19682__NA

SEQ ID NO: 29548 - RNA, 1401 nt, Artificial Sequence; identical to SEQ ID NO: 29526
  derived and/or modified CDS sequence (AUadapt) from InfluenzaB__AGX19704__NA

SEQ ID NO: 29549 - RNA, 1401 nt, Artificial Sequence
  derived and/or modified CDS sequence (AUadapt) from InfluenzaB__AGX19715__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcacgccgugaaccgcuccaccaccaagggcgucacccuccugcugcccgagccggaguggacguacccccggcucagcugccccggguccaccuuccagaaggcccugcugaucagcccccaucgcuucggcgagaccaaggggaacuccgccccgcucaucauccgggagcccuucaucgcgugcggccccaacgagugcaagcauuucgcccugacccacuacgccgcccagcccggcggguacuacaacggcacgcgcggggaccggaauaagcugcgccaccucaucucggugaagcugggcaagaucccgaccguggagaacuccaucuuccacauggcggccuggagcggguccgccugucacgacggcaaggaguggaccuacaucggcgucgacgggcccgacaacaaugcccugcucaagaucaaguacggcgaggccuacaccgacacguaccacagcuacgcgaauaacauccugcggacccaggaguccgccugcaacugcaucgggggcaacugcuaucugaugaucaccgacggcagcgccucggggguguccgagugccgcuuccucaagauccgggagggccgcaucaucaaggagaucuuccccaccgggcgggugaagcacacggaggaguguacgugcggcuucgccagcaacaagaccaucgagugcgccugccgcgauaacuccuacaccgcgaagcggcccuucgucaagcugaacguggagaccgacaccgccgagauccgccugaugugcaccgauaccuaccucgacacgccgcggcccgacgacgggagcaucaccggccccugcgaguccaacggcgauaaggggagcggcgggaucaagggcggguucgugcaccagcgcauggccuccaagaucggccggugguacucgcgcaccauguccaagaccgagcggaugggcauggggcuguacgucaaguaugacggcgaccccugggccgacagcgacgcccuggcguucuccggggugauggugagcaugaaggagccgggcugguauuccuucggguucgagaucaaggacaagaagugcgacguccccugcaucggcaucgagauggugcaugacggcgggaaggagacguggcacagcgccgccaccgccaucuacugccucaugggcuccgggcagcugcugugggacaccgugaccggcgucgacauggcccucuga

SEQ ID NO: 29550 - RNA, 1401 nt, Artificial Sequence; identical to SEQ ID NO: 28640
  derived and/or modified CDS sequence (AUadapt) from InfluenzaB__AGX19726__NA

SEQ ID NO: 29551 - RNA, 1401 nt, Artificial Sequence; identical to SEQ ID NO: 28640
  derived and/or modified CDS sequence (AUadapt) from InfluenzaB__AGX19737__NA

SEQ ID NO: 29552 - RNA, 1401 nt, Artificial Sequence; identical to SEQ ID NO: 28640
  derived and/or modified CDS sequence (AUadapt) from InfluenzaB__AGX19748__NA

SEQ ID NO: 29553 - RNA, 1401 nt, Artificial Sequence; identical to SEQ ID NO: 29526
  derived and/or modified CDS sequence (AUadapt) from InfluenzaB__AGX19759__NA

SEQ ID NO: 29554 - RNA, 1401 nt, Artificial Sequence; identical to SEQ ID NO: 28640
  derived and/or modified CDS sequence (AUadapt) from InfluenzaB__AGX19770__NA

SEQ ID NO: 29555 - RNA, 1401 nt, Artificial Sequence; identical to SEQ ID NO: 28640
  derived and/or modified CDS sequence (AUadapt) from InfluenzaB__AGX19781__NA

SEQ ID NO: 29556 - RNA, 1401 nt, Artificial Sequence; identical to SEQ ID NO: 28640
  derived and/or modified CDS sequence (AUadapt) from InfluenzaB__AGX19792__NA

SEQ ID NO: 29557 - RNA, 1401 nt, Artificial Sequence; identical to SEQ ID NO: 28640
  derived and/or modified CDS sequence (AUadapt) from InfluenzaB__AGX19803__NA

SEQ ID NO: 29558 - RNA, 1401 nt, Artificial Sequence; identical to SEQ ID NO: 28640
  derived and/or modified CDS sequence (AUadapt) from InfluenzaB__AGX19814__NA

SEQ ID NO: 29559 - RNA, 1401 nt, Artificial Sequence
  derived and/or modified CDS sequence (AUadapt) from InfluenzaB__AGX19825__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaacgugcaugccgugaaccacuccgccaccaagggcgucacccuccugcugcccgagccggaguggaccuacccccgccucagcugccccggguccacguuccagaaggcccugcugaucaguccccaccgguucggcgagaccaaggggaacuccgcgccgcucaucauccgcgagcccuucaucgccugcggccccaacgagugcaagcauuucgcccugacccacuacgccgcgcagcccggcggguacuacaacggcacccgcggggaucggaacaagcugcggcaccucaucagcgugaagcugggcaagaucccgacgguggagaacuccaucuuccacauggccgccuggagcggguccgccugucacgacggcaaggaguggaccuacaucggcgucgacgggcccgacaacaaugcccugcucaagaucaaguacggcgaggcguacaccgacaccuaccacucguacgccaauaacauccugcgcacgcaggaguccgccugcaacugcaucgggggcaacugcuaucugauggugaccgacggcagcgccagcgggguguccgagugccgguuccucaagauccgcgagggccggaucaucaaggagaucuuccccaccgggcgcgucaagcacaccgaggaguguacgugcggcuucgccaacaacaagaccaucgagugcgcgugccgggauaacucguacaccgccaagcgccccuucgugaagcugaacguggagaccgacacggccgagauccggcugaugugcaccgauaccuaccucgacaccccgcgccccgacgacggguccaucacgggccccugcgagagcaauggcgacaagggguccggcgggaucaagggcggguucguccaccagcggauggccagcaagaucggccgcugguacucccggaccaugucgaagaccgagcgcaugggcauggggcuguacgugaaguaugacggcgaccccugggccgacuccgacgcgcuggccuucagcggggugauggucuccaugaaggagccgggcugguauagcuucggguucgagaucaaggacaagaagugcgacgugcccugcaucggcaucgagauggugcaugacggcgggaaggagaccuggcacuccgccgccacggccaucuacugccucaugggcagcgggcagcugcugugggacaccgucaccggcguggacauggcgcucuga

SEQ ID NO: 29560 - RNA, 1401 nt, Artificial Sequence; identical to SEQ ID NO: 28640
  derived and/or modified CDS sequence (AUadapt) from InfluenzaB__AGX19836__NA

SEQ ID NO: 29561 - RNA, 1401 nt, Artificial Sequence; identical to SEQ ID NO: 28640
  derived and/or modified CDS sequence (AUadapt) from InfluenzaB__AGX19847__NA

SEQ ID NO: 29562 - RNA, 1401 nt, Artificial Sequence; identical to SEQ ID NO: 28640
  derived and/or modified CDS sequence (AUadapt) from InfluenzaB__AGX19858__NA

SEQ ID NO: 29563 - RNA, 1401 nt, Artificial Sequence; identical to SEQ ID NO: 28640
  derived and/or modified CDS sequence (AUadapt) from InfluenzaB__AGX19869__NA

SEQ ID NO: 29564 - RNA, 1401 nt, Artificial Sequence; identical to SEQ ID NO: 28640
  derived and/or modified CDS sequence (AUadapt) from InfluenzaB__AGX19880__NA

SEQ ID NO: 29565 - RNA, 1401 nt, Artificial Sequence; identical to SEQ ID NO: 28640
  derived and/or modified CDS sequence (AUadapt) from InfluenzaB__AGX19891__NA

SEQ ID NO: 29566 - RNA, 1401 nt, Artificial Sequence; identical to SEQ ID NO: 28640
  derived and/or modified CDS sequence (AUadapt) from InfluenzaB__AGX19902__NA

SEQ ID NO: 29567 - RNA, 1401 nt, Artificial Sequence
  derived and/or modified CDS sequence (AUadapt) from InfluenzaB__AGX19913__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcacgccaugaaccacuccgccaccaagggcgugacccuccugcugcccgagccggaguggaccuacccccgccucagcugccccggguccacguuccagaaggcccugcugaucaguccccaccgguucggcgagaccaaggggaacuccgcgccgcucaucauccgcgagcccuucaucgccugcggccccaacgaguguaagcacuucgcccugacccacuacgccgcgcagcccggcggguacuacaacggcacccgcggggaucggaacaagcugcggcaccucaucucggucaagcugggcaagaucccgacgguggagaacuccaucuuccacauggccgccuggaguggguccgccugccacgacggcaaggaguggaccuacaucggcguggacgggcccgacaacaaugcccugcucaagaucaaguacggcgaggcguacaccgacaccuaccacagcuaugccaacaacauccugcgcacgcaggaguccgccugcaacugcaucgggggcaacugcuaucugauggucaccgacggcagcgccucggggguguccgagugccgguuccucaagauccgcgagggccggaucaucaaggagaucuuccccaccgggcgcgugaagcauaccgaggagugcacgugcggcuucgccagcaacaagaccaucgagugcgcgugccgggauaacuccuacaccgccaagcgccccuucgucaagcugaacguggagaccgacacggccgagauccggcugaugugcaccgauaccuaccucgacaccccgcgccccgacgacgggagcaucacgggccccugcgaguccaacggcgauaaggggagcggcgggaucaagggcggguucgugcaccagcggauggccuccaagaucggccgcugguacucgcggaccauguccaagaccgagcgcaugggcauggggcuguacgucaaguaugacggcgaccccugggccgacagcgacgcgcuggccuucuccggggugauggugagcaugaaggagccgggcugguauuccuucggguucgagaucaaggacaagaagugcgacguccccugcaucggcaucgagauggugcaugacggcgggaaggagaccuggcacagcgccgccacggccaucuacugccucaugggcuccgggcagcugcugugggacaccgugaccggcgucgacauggcgcucuga

SEQ ID NO: 29568 - RNA, 1401 nt, Artificial Sequence; identical to SEQ ID NO: 28640
  derived and/or modified CDS sequence (AUadapt) from InfluenzaB__AGX19924__NA

SEQ ID NO: 29569 - RNA, 1401 nt, Artificial Sequence; identical to SEQ ID NO: 28640
  derived and/or modified CDS sequence (AUadapt) from InfluenzaB__AGX19935__NA

SEQ ID NO: 29570 - RNA, 1401 nt, Artificial Sequence; identical to SEQ ID NO: 28640
  derived and/or modified CDS sequence (AUadapt) from InfluenzaB__AGX19946__NA

SEQ ID NO: 29571 - RNA, 1401 nt, Artificial Sequence; identical to SEQ ID NO: 28640
  derived and/or modified CDS sequence (AUadapt) from InfluenzaB__AGX19957__NA

SEQ ID NO: 29572 - RNA, 1401 nt, Artificial Sequence
  derived and/or modified CDS sequence (AUadapt) from InfluenzaB__AGX19968__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccgcuccgccaccaagggcgucacccuccugcugcccgagccggaguggaccuacccccggcucagcugccccggguccacguuccagaaggcccugcugaucagcccccaucgcuucggcgagaccaaggggaacuccgcgccgcucaucauccgggagcccuucaucgccugcggccccaacgagugcaagcacuuugcccugacccacuacgccgcgcagcccggcggguacuacaacggcacccgcggggaccggaauaagcugcgccaccucaucucggugaagcugggcaagaucccgacgguggagaacuccaucuuccacauggccgccuggagcggguccgccugucacgacggcaaggaguggaccuacaucggcgucgacgggcccgacaacgacgcccugcucaaggugaaguauggcgaggcguacaccgacaccuaccacagcuacgccaauaagauccugcggacgcaggaguccgccugcaacugcaucgggggcaacugcuaccugaugaucaccgauggcagcgccucggggguguccgagugccgcuuccucaagauccgggagggccgcaucaucaaggagaucuuccccaccgggcgggucaagcacaccgaggaguguacgugcggcuucgccagcaacaagaccaucgagugcgcgugccgcgacaauuccuacaccgccaagcggcccuucgugaagcugaacguggagaccgacacggccgagauccgccugaugugcaccgacaccuaucucgacaccccgcggcccaacgacgggagcaucacgggccccugcgaguccaacggcgauaaggggagcggcgggaucaagggcggguucguccaccagcgcauggaguccaagaucggccggugguacucgcgcaccauguccaagaccgagcggaugggcauggggcuguacgugaaguacgauggcgaccccugggccgacagcgacgcccuggcguucuccggggugauggucagcaugaaggagccgggcugguauuccuucggguucgagaucaaggacaagaagugcgacgugcccugcaucggcaucgagauggugcaugacggcgggaaggagaccuggcacagcgccgccacggccaucuacugccucaugggcuccgggcagcugcugugggacaccgucaccggcgugaacauggcccucuga

SEQ ID NO: 29573 - RNA, 1401 nt, Artificial Sequence; identical to SEQ ID NO: 29526
  derived and/or modified CDS sequence (AUadapt) from InfluenzaB__AGX19979__NA

SEQ ID NO: 29574 - RNA, 1401 nt, Artificial Sequence; identical to SEQ ID NO: 29526
  derived and/or modified CDS sequence (AUadapt) from InfluenzaB__AGX19990__NA

SEQ ID NO: 29575 - RNA, 1401 nt, Artificial Sequence; identical to SEQ ID NO: 28640
  derived and/or modified CDS sequence (AUadapt) from InfluenzaB__AGX20001__NA

SEQ ID NO: 29576 - RNA, 1401 nt, Artificial Sequence; identical to SEQ ID NO: 28640
  derived and/or modified CDS sequence (AUadapt) from InfluenzaB__AGX20012__NA

SEQ ID NO: 29577 - RNA, 1401 nt, Artificial Sequence; identical to SEQ ID NO: 28640
  derived and/or modified CDS sequence (AUadapt) from InfluenzaB__AGX20023__NA

SEQ ID NO: 29578 - RNA, 1401 nt, Artificial Sequence; identical to SEQ ID NO: 28640
  derived and/or modified CDS sequence (AUadapt) from InfluenzaB__AGX20034__NA

SEQ ID NO: 29579 - RNA, 1401 nt, Artificial Sequence; identical to SEQ ID NO: 28640
  derived and/or modified CDS sequence (AUadapt) from InfluenzaB__AGX20045__NA

SEQ ID NO: 29580 - RNA, 1401 nt, Artificial Sequence
  derived and/or modified CDS sequence (AUadapt) from InfluenzaB__AGX20056__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaugauccgggagcccuucaucgccugcggccccaacgaguguaagcacuucgcccugacccacuacgccgcgcagcccggcggguacuacaauggcacccgcggggaccggaacaagcugcgccaccucaucagcgugaagcugggcaagaucccgacgguggagaacuccaucuuccauauggccgccuggagcggguccgccugccacgacggcaaggaguggaccuacaucggcgucgacgggcccgauaacaacgcccugcucaaggugaaguacggcgaggcguacaccgacaccuaccauucguacgccaacaagauccugcggacgcaggaguccgccugcaacugcaucgggggcaauugcuaccugauggugaccgacggcagcgccagcggggucuccgagugucgcuuccucaagauccgggagggccgcaucaucaaggagaucuuccccaccgggcgggugaagcacaccgaggagugcacgugcggcuucgccaguaacaagaccaucgagugcgcgugccgcgacaacuccuacaccgccaagcggcccuuugugaagcugaacgucgagaccgacacggccgagauccgccugaugugcaccgacaccuaccucgacaccccgcggcccaaugacgggagcaucacgggccccugcgaguccaacggcgacaaggggucgggcgggaucaagggcggguuugugcaccagcgcauggaguccaagaucggccggugguacagccgcaccauguccaagaccgagcggaugggcauggggcuguacgugaaguacgacggcgaucccugggccgacagcgacgcccuggcguucuccggggucauggugagcaugaaggagccgggcugguacuccuuuggguucgagaucaaggacaagaagugcgacgugcccugcaucggcaucgagaugguccacgauggcgggaaggagaccuggcacagcgccgccacggccaucuacugccucaugggcuccgggcagcugcugugggacaccgugaccggcguggacauggcccucuga

SEQ ID NO: 29581 - RNA, 1401 nt, Artificial Sequence
  derived and/or modified CDS sequence (AUadapt) from InfluenzaB__AGX20067__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaacgaguguaagcacuucgcccugacccacuacgccgcgcagcccggcggguacuacaauggcacccgcggggaccggaacaagcugcgccaccucaucagcgugaagcugggcaagaucccgacgguggagaacuccaucuuccauauggccgccuggagcggguccgccugccacgacggcaaggaguggaccuacaucggcgucgacgggcccgauaacaacgcccugcucaaggugaaguacggcgaggcguacaccgacaccuaccauucguacgccaacaagauccugcggacgcaggaguccgccugcaacugcaucgggggcaauugcuaccugauggugaccgacggcagcgccagcggggucuccgagugucgcuuccucaagauccgggagggccgcaucaucaaggagaucuuccccaccgggcgggugaagcacaccgaggagugcacgugcggcuucgccaguaacaagaccaucgagugcgcgugccgcgacaacuccuacaccgccaagcggcccuuugugaagcugaacgucgagaccgacacggccgagauccgccugaugugcaccgacaccuaccucgacaccccgcggcccaaugacgggagcaucacgggccccugcgaguccaacggcgacaaggggucgggcgggaucaagggcggguuugugcaccagcgcauggaguccaagaucggccggugguacagccgcaccauguccaagaccgagcggaugggcauggggcuguacgugaaguacgacggcgaucccugggccgacagcgacgcccuggcguucuccggggucauggugagcaugaaggagccgggcugguacuccuuuggguucgagaucaaggacaagaagugcgacgugcccugcaucggcaucgagaugguccacgauggcgggaaggagaccuggcacagcgccgccacggccaucuacugccucaugggcuccgggcagcugcugugggacaccgugaccggcguggacauggcccucuga

SEQ ID NO: 29582 - RNA, 1401 nt, Artificial Sequence; identical to SEQ ID NO: 28640
  derived and/or modified CDS sequence (AUadapt) from InfluenzaB__AGX20078__NA

SEQ ID NO: 29583 - RNA, 1401 nt, Artificial Sequence; identical to SEQ ID NO: 28640
  derived and/or modified CDS sequence (AUadapt) from InfluenzaB__AGX20089__NA

SEQ ID NO: 29584 - RNA, 1401 nt, Artificial Sequence
  derived and/or modified CDS sequence (AUadapt) from InfluenzaB__AGX20100__NA
augcugcccaguaccauccagacccucacgcuguuccugaccuccggcggggugcuccugagccuguacgucuccgccagccucuccuaccugcuguauucggacauccuccugaaguucccguccaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaaggagugcaagcauuucgcccugacccacuacgccgcgcagcccggcggguacuacaauggcacccgcggggaccggaacaagcugcgccaccucaucucggugaagcugggcaagaucccgacgguggagaacuccaucuuccauauggccgccuggagcggguccgccugccacgacggcaaggaguggaccuacaucggcgucgacgggcccgauaacaacgccgugcugaagaucaaguacggcgaggcguacaccgacaccuaccauagcuacgccaacaacauccuccggacgcaggaguccgccugcaacuguaucgggggcaacugcuaccugaugaucaccgacggcagcgccagugggguguccgagugccgcuuccugaagauccgggagggccgcaucaucaaggagaucuuccccaccgggcggauccagcacaccgaggagugcacgugcggcuuugccagcaacaagaccaucgagugcgcgugccgcgacaacuccuauaccgccaagcggcccuucgucaagcucaacguggagaccgacacggccgagauccgccugaugugcaccaagaccuaccuggacaccccgcggcccgaugacgggagcaucacgggccccugcgaguccaacggcgggaagggcagcgggggcaucaagggcggguuugugcaccagcgcauggccuccaagaucggccggugguacucgcgcaccauguccaagaccgagcggaaggggaugggccucuacgucaaguacgacggggaucccugggccgacagcgacgcgcuggccuucuccggcgugauggugagcauggaggagccggggugguacuccuuuggcuucgagaucaaggacaagaagugcgacguccccugcaucggcaucgagauggugcacgaugggggcaaggagaccuggcacagcgccgccacggccaucuacugccugaugggguccggccagcuccugugggacaccgugaccggcgucaacauggcgcuguga

SEQ ID NO: 29585 - RNA, 1401 nt, Artificial Sequence
  derived and/or modified CDS sequence (AUadapt) from InfluenzaB__AGX20111__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccgcuccgccaccaagggcgucacccuccugcugcccgagccggaguggaccuacccccggcucagcugccccggguccacguuccagaaggcccugcugaucagcccccaucgcuucggcgagaccaaggggaacuccgcgccgcucaucauccgggagcccuucaucgccugcggccccaacgagugcaagcacuuugcccugacccacuacgccgcgcagcccggcggguacuacaacggcacccgcggggaccggaauaagcugcgccaccucaucucggugaagcugggcaagaucccgacgguggagaacuccaucuuccacauggccgccuggagcggguccgccugucacgacggcaaggaguggaccuacaucggcgucgacgggcccgacaacaacgcccugcucaaggugaaguauggcgaggcguacaccgacaccuaccacagcuacgccaauaagauccugcggacgcaggaguccgccugcaacugcaucgggggcaacugcuaccugaugaucaccgauggcagcgccucggggguguccgagugccgcuuccucaagauccgggagggccgcaucaucaaggagaucuuccccaccgggcgggucaagcacaccgaggaguguacgugcggcuucgccagcaacaagaccaucgagugcgcgugccgcgacaauuccuacaccgccaagcggcccuucgugaagcugaacguggagaccgacacggccgagauccgccugaugugcaccgacaccuaucucgacaccccgcggcccgacgacgggagcaucacgggccccugcgaguccaacggcgauaaggggagcggcgggaucaagggcggguucguccaccagcgcauggaguccaagaucggccggugguacucgcgcaccauguccaagaccgagcggaugggcauggggcuguacgugaaguacgauggcgaccccugggccgacagcgacgcccugaccuucuccggggugauggucagcaugaaggagccgggcugguauuccuucggguucgagaucaaggacaagaagugcgacgugcccugcaucggcaucgagauggugcaugacggcgggaaggagacguggcacagcgcggccaccgccaucuacugccucaugggcuccgggcagcugcugugggacaccgucaccggcguggacauggcccucuga

SEQ ID NO: 29586 - RNA, 1401 nt, Artificial Sequence
  derived and/or modified CDS sequence (AUadapt) from InfluenzaB__AGX20122__NA
augcugcccaguaccauccagacccucacgcuguuccugaccuccggcggggugcuccugagccuguacgucuccgcccuccugagcuaccugcucuauuccgacauccugcugaaguucagcccgaccgagaucaccgcccccacgaugucccucgacugcgcgaacgccaguaacgugcaggccgugaaccgcuccgccaccaagggcgucaccuuccugcugcccgagcccgaguggaccuacccgcggcucagcugucccggguccacguuccagcgcgcccugcugaucagcccccaccgguucggcgagaccaaggggaacuccgcgccccucaucauccgcgagccguucaucgccuguggccccaacgagugcaagcacuucgcccugacccacuaugccgcgcagcccggcggguacuacaacggcacccgcggggaccggaacaagcugcggcaccucaucagugugaagcugggcaagauccccacgguggagaacuccaucuuccacauggccgccuggagcggguccgccugccacgauggcaaggaguggaccuacaucggcgucgacgggccggacaacgacgcccugcucaaggugaaguauggcgaggcguacaccgacaccuaccacagcuacgccaauaagauccugcgcacgcaggaguccgccugcaacugcaucgggggcaacugcuaucugaugaucaccgacggcagcgccagcgggguguccgagugccgguuccucaagauccgcgagggccggaucaucaaggagaucuuccccaccgggcgcgucaagcauaccgaggagugcacgugcggcuucgccagcaacaagaccaucgagugugcgugccgggacaacuccuacaccgccaagcgccccuucgugaagcugaacguggagaccgauacggccgagauccggcugaugugcaccgacaccuaccucgacacgccccgcccggacgacgggaguaucaccggccccugcgaguccaacggcgacaaggggagcggcgggaucaagggcggguucguccaucagcggauggaguccaagaucggccgcugguacagccggaccauguccaagaccgagcgcaugggcauggggcuguacgugaaguacgacggcgaccccugggccgauagcgacgcccuggcguucuccggggugauggucagcaugaaggagcccggcugguacuccuuuggguucgagaucaaggacaagaagugcgacgugccgugcaucggcaucgagauggugcacgauggcgggaaggagaccuggcacagcgccgccacggccaucuacugccucaugggcuccgggcagcugcugugggacaccgucaccggcguggacauggcccucuga

SEQ ID NO: 29587 - RNA, 1401 nt, Artificial Sequence
  derived and/or modified CDS sequence (AUadapt) from InfluenzaB__AGX20133__NA
augcugcccaguaccauccagacccucacgcuguuccugaccuccggcggggugcuccugagccuguacgucuccgcccuccugagcuaccugcucuauuccgacgugcugcugaaguucagcccgaccgagaucaccgcccccacgaugucccucgacugcgcgaacgccaguaacgugcaggccgucaaccgcuccgccaccaagggcgugaccuuccugcugcccgagcccgaguggaccuacccgcggcucagcugccccggguccacguuucagaaggcccugcugaucagcccccaccgcuucggcgagaccaaggggaacuccgcgccccucaucauccgggagccguucaucgccugcggccccaaugagugcaagcacuucgcccugacccacuacgccgcgcagcccggcggguacuauaacggcacccgcggggaccggaacaagcugcgccaccucaucagcgugaagcugggcaagauccccacggucgagaacuccaucuuucacauggccgccuggagcggguccgccugccacgacggcaaggaguggaccuacaucggcguggaugggccggacaacgacgcccugcucaaggugaaguacggcgaggcguacaccgacaccuaucacucguacgccaacaagauccugcggacgcaggaguccgccugcaacuguaucgggggcaacugcuaccugaugaucaccgacggcagcgccagcggggucuccgagugucgcuuccucaagauccgggagggccgcaucaucaaggagaucuuccccaccgggcgggugaagcacaccgaggagugcacgugcggcuucgccaguaacaagaccaucgagugcgcgugccgcgacaacuccuacaccgccaagcggcccuuugugaagcugaacgucgagaccgacacggccgagauccgccugaugugcaccgacaccuaccucgacacgccccggccggaugacgggagcaucaccggccccugcgaguccaacggcgacaaggggagcggcgggaucaagggcggguuugugcaccagcgcauggaguccaagaucggccggugguacagccgcaccauguccaagaccgagcggaugggcauggggcuguacgugaaguacgacggcgaucccugggccgacagcgacgcccuggcguucuccggggucauggugagcaugaaggagcccggcugguacuccuuuggguucgagaucaaggacaagaagugcgacgugccgugcaucggcaucgagaugguccacgauggcgggaaggagaccuggcacagcgccgccacggccaucuacugccucaugggcuccgggcagcugcugugggacaccgugaccggcguggacauggcccucuga

SEQ ID NO: 29588 - RNA, 1401 nt, Artificial Sequence
  derived and/or modified CDS sequence (AUadapt) from InfluenzaB__AGX20144__NA
augcugcccaguaccauccagacccucacgcuguuccugaccuccggcggggugcuccugagccuguacgucuccgcccuccugagcuaccugcucuacuccgauauccugcugaaguucagcccgaccgagaucaccgcccccacgaugucccucgacugcgcgaacgccucgaacgugcaggccgugaaucgcuccgccaccaagggcgucaccuuccugcugcccgagcccgaguggaccuacccgcggcucagcugccccggguccacguuccagaaggcccugcugaucagcccccaccgcuuuggcgagaccaaggggaacuccgcgccccucaucauccgggagccguucaucgccugcggccccaacgagugcaagcacuucgcccugacccauuacgccgcgcagcccggcggguacuacaacggcacccgcggggaccggaacaagcugcgccaccucaucagugugaagcugggcaagauccccacgguggagaacuccaucuuccacauggccgccuggagcggguccgccugccacgauggcaaggaguggaccuacaucggcgucgacgggccggacaacgacgcccugcucaaggugaaguacggcgaggcguacaccgauaccuaccacucguacgccaacaagauccugcggacgcaggaguccgccugcaacuguaucgggggcaacugcuaccugaugaucaccgacggcagcgccagcgggaucuccgagugccgcuuucucaagauccgggagggccgcaucaucaaggagaucuuccccaccgggcgggugaagcacaccgaggagugcacgugcggcuucgccagcaacaagaccaucgagugugcgugccgcgacaacuccuacaccgccaagcggcccuucgucaagcugaacguggagaccgauacggccgagauccgccugaugugcaccgacaccuaccucgacacgccccggccggacgacgggagcaucaccggccccugugaguccaacggcgacaaggggucgggcgggaucaagggcggguucgugcaccagcgcauggaguccaagaucggccggugguacagccgcaccauguccaagaccgagcggaugggcauggggcuguaugucaaguacgacggcgaccccugggccgacagcgacgcccuggcguucuccggggugauggugaguaugaaggagcccggcugguacuccuucggguucgagaucaaggacaagaagugcgacgucccgugcaucggcaucgagauggugcaugacggcgggaaggagaccuggcacagcgccgccacggccaucuacugccucaugggcuccgggcagcugcugugggacaccgugaccggcgucgacauggcccucuga

SEQ ID NO: 29589 - RNA, 1401 nt, Artificial Sequence; identical to SEQ ID NO: 29588
  derived and/or modified CDS sequence (AUadapt) from InfluenzaB__AGX20155__NA

SEQ ID NO: 29590 - RNA, 1401 nt, Artificial Sequence; identical to SEQ ID NO: 29588
  derived and/or modified CDS sequence (AUadapt) from InfluenzaB__AGX20166__NA

SEQ ID NO: 29591 - RNA, 1401 nt, Artificial Sequence; identical to SEQ ID NO: 28662
  derived and/or modified CDS sequence (AUadapt) from InfluenzaB__AGX20177__NA

SEQ ID NO: 29592 - RNA, 1401 nt, Artificial Sequence; identical to SEQ ID NO: 28662
  derived and/or modified CDS sequence (AUadapt) from InfluenzaB__AGX20188__NA

SEQ ID NO: 29593 - RNA, 1401 nt, Artificial Sequence; identical to SEQ ID NO: 28985
  derived and/or modified CDS sequence (AUadapt) from InfluenzaB__AGX20199__NA

SEQ ID NO: 29594 - RNA, 1401 nt, Artificial Sequence; identical to SEQ ID NO: 28662
  derived and/or modified CDS sequence (AUadapt) from InfluenzaB__AGX20210__NA

SEQ ID NO: 29595 - RNA, 1401 nt, Artificial Sequence; identical to SEQ ID NO: 29588
  derived and/or modified CDS sequence (AUadapt) from InfluenzaB__AGX20221__NA

SEQ ID NO: 29596 - RNA, 1401 nt, Artificial Sequence
  derived and/or modified CDS sequence (AUadapt) from InfluenzaB__AGX20232__NA
augcugcccaguaccauccagacccucacgcuguuccugaccuccggcggggugcuccugagccuguacgucuccgccagccucuccuaccugcuguauagcggcauccuccugaaguucuccccgaccgagaucaccgcccccacgaugccccuggacugcgcgaacgccagcaaugugcaggccgugaaccgcuccgccaccaagggggucaccuuccuccugcccgagccggaguggaccuacccccggcugagcugccccggcuccacguuucagaaggcccuccugaucucgccccaccgcuucggggagaccaagggcaacuccgcgccgcugaucauccgggagcccuucaucgccugcggccccaaugagugcaagcacuucgcccucacccacuacgccgcgcagcccgggggcuauuacaacgggacccgcggcgaccggaacaagcugcgccaccugaucagcgugaagcucgggaagaucccgacgguggagaauuccaucuuccacauggccgccuggagcggcuccgccugccacgauggcaaggaguggaccuacaucggggucgacggccccgacaacaacgcccugcugaaggugaaguacggggaggcguauaccgacaccuaccacagcuacgccaauaagauccuccggacgcaggaguccgccugcaacugcaucggcggcaacugcuaccugaugaucaccgaugggagcgccagcggcguguccgagugccgcuuccugaagauccgggaggggcgcaucaucaaggagaucuuccccaccggccgggucaagcauaccgaggagugcacgugcggguucgccucgaacgagaccaucgagugcgcgugucgcgacaacuccuacaccgccaagcggcccuucgugaagcucaacguggagaccgauacggccgagauccgccugaugugcaccgacaccuaccuggacaccccgcggcccaacgacggcaguaucacgggccccugcgaguccaacggggacaagggcgggggcgggaucaagggcggcuucguccaccagcgcauggagaguaagaucgggcggugguacucccgcaccaugagcaagaccgagcggaugggcauggggcucuacgugaaguacgacggcgaccccugggccgauuccgacgcccuggcguucagcggggugauggucuccaugaaggagccgggcugguacagcuuuggcuucgagaucaaggacaagaagugcgacgugcccugcaucgggaucgagauggugcacgauggcgggaaggagaccuggcacuccgccgccacggccaucuacugccugaugggcagcggccagcuccugugggacaccgucaccgggguggacauggcccuguga

SEQ ID NO: 29597 - RNA, 1401 nt, Artificial Sequence; identical to SEQ ID NO: 28662
  derived and/or modified CDS sequence (AUadapt) from InfluenzaB__AGX20243__NA

SEQ ID NO: 29598 - RNA, 1401 nt, Artificial Sequence; identical to SEQ ID NO: 29588
  derived and/or modified CDS sequence (AUadapt) from InfluenzaB__AGX20254__NA

SEQ ID NO: 29599 - RNA, 1401 nt, Artificial Sequence; identical to SEQ ID NO: 28985
  derived and/or modified CDS sequence (AUadapt) from InfluenzaB__AGX20265__NA

SEQ ID NO: 29600 - RNA, 1401 nt, Artificial Sequence; identical to SEQ ID NO: 29588
  derived and/or modified CDS sequence (AUadapt) from InfluenzaB__AGX20276__NA

SEQ ID NO: 29601 - RNA, 1401 nt, Artificial Sequence; identical to SEQ ID NO: 28662
  derived and/or modified CDS sequence (AUadapt) from InfluenzaB__AGX20287__NA

SEQ ID NO: 29602 - RNA, 1401 nt, Artificial Sequence
  derived and/or modified CDS sequence (AUadapt) from InfluenzaB__AGX20298__NA
augcugcccaguaccauccagacccucacgcuguuccugaccuccggcggggugcuccugagccuguacgucuccgcccuccugagcuaccugcucuacuccgauauccugcugaaguucagcccgaccgagaucaccgcccccacgaugucccucgacugcgcgaacgccagcaaugugcaggccgugaaccgcuccgccaccaagggcgucaccuuccugcugcccgagcccgaguggaccuacccgcggcucagcugccccggguccacguuccagaaggcccugcugaucaguccccaccgcuucggcgagaccaaggggaacuccgcgccccucaucauccgggagccguucaucgccugcggccccaacgagugcaagcauuucgcccugacccacuacgccgcgcagcccggcggguacuacaacggcacccgcggggaucggaacaagcugcgccaccucaucagcgugaagcugggcaagauccccacgguggagaacuccaucuuccacauggccgccuggaguggguccgccugccacgacggcaaggaguggaccuacaucggcgucgacgggccggacaacgaugcccugcucaaggugaaguacggcgaggcguacaccgacaccuaccacagcuaugccaacaagauccugcggacgcaggaguccgccugcaacugcaucgggggcaacugcuaucugaugaucaccgacggcagcgccagcgggguguccgagugccgcuuccucaagauccgggagggccgcaucaucaaggagaucuuccccaccgggcgggucaagcauaccgaggagugcacgugcggcuucgccucgaacaagaccaucgagugcgcgugccgcgauaacuccuacaccgccaagcggcccuucgugaagcugaacguggagaccgacacggccgagauccgccugaugugcaccgauaccuaccucgacacgccccggccggacgacgggagcaucaccggccccugcgaguccaauggcgacaaggggagcggcgggaucaagggcggguucguccaccagcgcauggaguccaagaucggccggugguacagccgcaccauguccaagaccgagcggaugggcauggggcuguacgugaaguaugacggcgaccccugggccgacagcgacgcccuggcguucuccggggugauggucaguaugaaggagcccggcugguacuccuucggguucgagaucaaggacaagaagugcgacgugccguguaucggcaucgagauggugcacgacggcgggaaggagaccuggcagagcgccgccacggccaucuacugccucaugggcuccgggcagcugcugugggacaccgucaccggcguggacauggcccucuga

SEQ ID NO: 29603 - RNA, 1401 nt, Artificial Sequence; identical to SEQ ID NO: 28985
  derived and/or modified CDS sequence (AUadapt) from InfluenzaB__AGX20320__NA

SEQ ID NO: 29604 - RNA, 1401 nt, Artificial Sequence; identical to SEQ ID NO: 28662
  derived and/or modified CDS sequence (AUadapt) from InfluenzaB__AGX20331__NA

SEQ ID NO: 29605 - RNA, 1401 nt, Artificial Sequence
  derived and/or modified CDS sequence (AUadapt) from InfluenzaB__AGX20342__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuucagaaggcccugcugaucucgccccaccgcuucggcgagaccaaggggaacuccgcgccgcucaucauccgggagcccuucaucgccugcggccccaaugagugcaagcacuucgcccugacccacuacgccgcgcagcccggcggguauuacaacggcacccgcggggaccggaacaagcugcgccaccucaucagcgugaagcugggcaagaucccgacgguggagaauuccaucuuccacauggccgccuggagcggguccgccugccacgauggcaaggaguggaccuacaucggcgucgacgggcccgacaacaacgcccugcucaaggugaaguacggcgaggcguauaccgacaccuaccacagcuacgccaauaagauccugcggacgcaggaguccgccugcaacugcaucgggggcaacugcuaccugauggugaccgauggcagcgccagcggggucuccgagugccgcuuccucaagauccgggagggccgcaucaucaaggagaucuuccccaccgggcgggugaagcauaccgaggagugcacgugcggcuucgccucgaacaagaccaucgagugcgcgugucgcgacaacuccuacaccgccaagcggcccuucgugaagcugaacgucgagaccgauacggccgagauccgccugaugugcaccgacaccuaccucgacaccccgcggcccgacgacgggaguaucacgggccccugcgaguccaacggcgacaaggggagcggcgggaucaagggcggguucgugcaucagcgcauggaguccaagaucggccggugguacagccgcaccauguccaagaccgagcggaugggcauggggcuguacgugaaguacgacggcgaccccugggccgauagcgacgcccuggcguucuccggggucauggugagcaugaaggagccgggcugguacuccuuuggguucgagaucaaggacaagaagugcgacgugcccugcaucggcaucgagaugguccacgauggcgggaaggagaccuggcacagcgccgccacggccaucuacugccucaugggcuccgggcagcugcugugggacaccgugaccggcguggacauggcccucuga

SEQ ID NO: 29606 - RNA, 1401 nt, Artificial Sequence
  derived and/or modified CDS sequence (AUadapt) from InfluenzaB__AGX20353__NA
augcugcccaguaccauccagacccucacgcuguuccugaccuccggcggggugcuccugagccuguacgucuccgcccuccugagcuaccugcucuacuccgacauccugcugaaguuuagcccgaccgagaucaucgcccccaccaugucccucgacugcgcgaacgccucgaacgugcaggccgugaaccgcuccgccacgaagggcgucaccuuucugcugcccgagcccgaguggaccuacccgcggcucagcugccccggguccaccuuccagaaggcccugcugaucagcccccaccgcuucggcgagacgaaggggaacuccgcgccccucaucauccgggagccguuuaucgccugcggccccaacgagugcaagcacuucgcccugacccacuacgccgcgcagcccggcggguauuacaaccgcacccggggcgaccgcaacaagcugcggcaccucaucagcgugaagcuggggaagauccccaccguggagaacuccaucuuucacauggccgccuggagcggcuccgccugccacgacgggaaggaguggacguacaucggcgucgacggcccggacaaugacgcccugcucaaggugaaguacggggaggcguacaccgacaccuaccacucguaugccaacaagauccugcgcacccaggaguccgccugcaacugcaucggcgggaacugcuaccugaugaucacggauggcagcgccagcggcaucuccgagugccgguuccucaagauccgcgaggggcggaucaucaaggagaucuuccccaccggccgcgugaagcacaccgaggagugcacgugcggguuugccagcaacaagaccaucgagugcgcgugccgggacaacuccuacaccgccaagcgccccuuugucaagcugaacguggagaccgacaccgccgagauccggcugaugugcacggacaccuaccucgacacgccccgcccggacgauggcagcaucaccgggcccugcgaguccaacggcgacaagggcucggggggcaucaagggcggguucgugcaccagcggauggaguccaagaucgggcgcugguacagucggaccauguccaagaccgagcgcaugggcaugggccuguacgucaaguacgacggggaccccugggccgacagcgacgcccuggcguuuuccggcgugauggugagcaugaaggagcccgggugguacuccuucggcuucgagaucaaggacaagaagugcgacgucccguguaucgggaucgagauggugcacgacggcggcaaggagaccuggcacagcgccgccaccgccaucuacugccucaugggguccggccagcugcugugggacacggugaccggggucgacauggcccucuga

SEQ ID NO: 29607 - RNA, 1401 nt, Artificial Sequence; identical to SEQ ID NO: 28662
  derived and/or modified CDS sequence (AUadapt) from InfluenzaB__AGX20364__NA

SEQ ID NO: 29608 - RNA, 1401 nt, Artificial Sequence; identical to SEQ ID NO: 29003
  derived and/or modified CDS sequence (AUadapt) from InfluenzaB__AGX20375__NA

SEQ ID NO: 29609 - RNA, 1401 nt, Artificial Sequence
  derived and/or modified CDS sequence (AUadapt) from InfluenzaB__AGX20386__NA
augcugcccaguaccauccagacccucacgcuguuccugaccuccggcggggugcuccugagccuguacgucuccgcccuccugagcuaccugcucuacuccgauauccugcugaaguucagcccgaccgagaucaccgcccccacgaugucccucgacugcgcgaacgccucgaaugugcaggccgugaaccgcuccgccaccaagggcgucaccuuccugcugcccgagcccgaguggacccacccgcggcucagcugccccggguccacguuccagaaggcccugcugaucagcccccaucgcuucggcgagaccaaggggaacuccgcgccccucaucauccgggagccguucaucgccugcggccccaacgagugcaagcauuucgcccugacccacuacgccgcgcagcccggcggguacuacaacggcacccgcggggaucggaacaagcugcgccaccucaucagcgugaagcugggcaagauccccacgguggagaacuccaucuuccacauggccgccuggagcggguccgccugucacgacggcaaggaguggaccuacaucggcgucgacgggccggacaacgaugcccugcucaaggugaaguacggcgaggcguacaccgacaccuaccacucguaugccaacaagauccugcggacgcaggaguccgccugcaacugcaucgggggcaacugcuaccugaugaucaccgauggcagcgccagcgggaucuccgagugccgcuuccucaagauccgggagggccgcaucaucaaggagaucuuccccaccgggcgggugaagcacaccgaggaguguacgugcggcuucgccagcaacaagaccaucgagugcgcgugccgcgauaacuccuacaccgccaagcggcccuucgucaagcugaacguggagaccgacacggccgagauccgccugaugugcaccgacaccuaucucgacacgccccggccggacgacgggagcaucaccggccccugcgaguccaacggcgauaaggggucgggcgggaucaagggcggguucgugcaccagcgcauggaguccaagaucggccggugguacagccgcaccauguccaagaccgagcggaugggcauggggcuguacgucaaguaugacggcgaccccugggccgacagcgacgcccuggcguucuccggggugauggugagcaugaaggagcccggcugguauuccuucggguucgagaucaaggacaagaagugcgacgucccgugcaucggcaucgagauggugcaugacggcgggaaggagaccuggcacagcgccgccacggccaucuacugccucaugggcuccgggcagcugcugugggacaccgugaccggcgucgacauggcccucuga

SEQ ID NO: 29610 - RNA, 1401 nt, Artificial Sequence; identical to SEQ ID NO: 28662
  derived and/or modified CDS sequence (AUadapt) from InfluenzaB__AGX20397__NA

SEQ ID NO: 29611 - RNA, 1401 nt, Artificial Sequence; identical to SEQ ID NO: 29003
  derived and/or modified CDS sequence (AUadapt) from InfluenzaB__AGX20408__NA

SEQ ID NO: 29612 - RNA, 1401 nt, Artificial Sequence; identical to SEQ ID NO: 28985
  derived and/or modified CDS sequence (AUadapt) from InfluenzaB__AGX20419__NA

SEQ ID NO: 29613 - RNA, 1401 nt, Artificial Sequence
  derived and/or modified CDS sequence (AUadapt) from InfluenzaB__AGX20430__NA
augcugcccaguaccauccagacccucacgcuguuccugaccuccggcggggugcuccugagccuguacgucuccgcccuccugagcuaccugcucuauuccgacauccugcugaaguucagcccgaccgagaucaccgcccccacgaugucccucgacugcgcgaaugccagcaacgugcaggccgugaaccgcuccgccaccaagggcgucaccuuccugcugcccgagcccgaguggaccuacccgcggcucaguugccccggguccacguuccagcgcgcccugcugaucagcccccaccgguucggcgaggcgaaggggaacuccgcgccccucaucauccgcgagccguuuaucgccugcggccccaacgagugcaagcacuucgcccugacccauuacgccgcccagcccggcggguacuacaacggcacccgcggggaccggaauaagcugcggcaccucaucagcgugaagcugggcaagauccccaccguggagaacuccaucuuccacauggccgccuggaguggguccgccugccacgacggcaaggaguggacguacaucggcgucgacgggccggacaaugacgcgcugcucaaggugaaguacggcgaggccuacaccgacaccuaccauagcuacgccaacaagauccugcgcacccaggaguccgccugcaacuguaucgggggcaacugcuaccugaugaucacggacggcagcgccagugggguguccgagugccgguuccucaagauccgcgagggccggaucaucaaggagaucuuccccaccgggcgcgucaagcacaccgaggagugcacgugcggcuuugcgagcaacaagaccaucgagugcgccugccgggacaauuccuacaccgccaagcgccccuucgugaagcugaacguggagaccgacaccgccgagauccggcugaugugcacggauaccuaccucgacacgccccgcccggacgacgggagcaucaccggccccugugaguccaacggcgacaaggggagcggcgggaucaagggcggguucguccaccagcggauggaguccaagaucggccgcugguacagucggaccauguccaagaccgagcgcaugggcauggggcuguacgugaaguacgacggcgaccccugggccgacagugacgcgcuggccuucuccggggugauggucagcaugaaggagcccggcugguacuccuucggguuugagaucaaggacaagaagugcgacgugccgugcaucggcaucgagauggugcacgauggcgggaaggagaccuggcacagcgccgccaccgccaucuacugccucaugggcuccgggcagcugcugugggacacggucaccggcguggacauggcgcucuga

SEQ ID NO: 29614 - RNA, 1401 nt, Artificial Sequence; identical to SEQ ID NO: 28985
  derived and/or modified CDS sequence (AUadapt) from InfluenzaB__AGX20441__NA

SEQ ID NO: 29615 - RNA, 1401 nt, Artificial Sequence
  derived and/or modified CDS sequence (AUadapt) from InfluenzaB__AGX20452__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugagccuggacugcgcgaaugccuccaacgugcaggccgugaaccgcagcgccaccaagggcgucaccuuccuccugcccgagcccgaguggaccuacccgcggcuguccugucccgggagcacguuccagaaggcccuccugaucagcccccaccgcuucggcgagaccaaggggaacuccgcgccccugaucauccgggagccguuuaucgccugcggccccaacgagugcaagcacuucgcccucacccacuaugccgcgcagcccggcggguacuacaacggcacccgcggggaccggaacaagcugcgccaucugaucuccgugaagcucggcaagauccccacgguggagaacagcaucuuccacauggccgccugguccgggagcgccugccaugacggcaaggaguggaccuacaucggcgucgacgggccggacaacgacgcccugcugaaggugaaguauggcgaggcguacaccgacaccuaccacuccuacgccaauaagauccuccggacgcaggagucggccugcaacugcaucgggggcaacugcuaucugaugaucaccgacggcagcgccuccggggugagcgagugccgcuuccugaagauccgggagggccgcaucaucaaggagaucuuucccaccgggcgggucaagcacaccgaggagugcacgugcggcuucgccuccaacaagaccaucgagugcgcgugucgcgacaacagcuacaccgccaagcggcccuucgugaagcucaacguggagaccgauacggccgagauccgccugaugugcaccgacaccuaccuggacacgccccggccggacgauggguccaucaccggccccugcgagagcaacggcgacaagggguccggcgggaucaagggcggguucguccaccagcgcauggagaguaagaucggccggugguacucccgcaccaugagcaagaccgagcggaugggcauggggcucuacgugaaguacgacggcgaccccugggccgauuccgacgcccuggcguucagcggggugauggucuccaugaaggagcccggcugguacagcuuuggguucgagauccgcgacaagaagugcgacgugccgugcaucggcaucgagauggugcacgauggcgggaaggagaccuggcacuccgccgccacggccaucuacugccugaugggcagcgggcagcuccugugggacaccgucaccggcguggacauggcccuguga

SEQ ID NO: 29616 - RNA, 1401 nt, Artificial Sequence; identical to SEQ ID NO: 28662
  derived and/or modified CDS sequence (AUadapt) from InfluenzaB__AGX20463__NA

SEQ ID NO: 29617 - RNA, 1401 nt, Artificial Sequence; identical to SEQ ID NO: 28662
  derived and/or modified CDS sequence (AUadapt) from InfluenzaB__AGX20474__NA

SEQ ID NO: 29618 - RNA, 1401 nt, Artificial Sequence; identical to SEQ ID NO: 28662
  derived and/or modified CDS sequence (AUadapt) from InfluenzaB__AGX20485__NA

SEQ ID NO: 29619 - RNA, 1401 nt, Artificial Sequence; identical to SEQ ID NO: 29588
  derived and/or modified CDS sequence (AUadapt) from InfluenzaB__AGX20496__NA

SEQ ID NO: 29620 - RNA, 1401 nt, Artificial Sequence; identical to SEQ ID NO: 28662
  derived and/or modified CDS sequence (AUadapt) from InfluenzaB__AGX20507__NA

SEQ ID NO: 29621 - RNA, 1401 nt, Artificial Sequence; identical to SEQ ID NO: 28662
  derived and/or modified CDS sequence (AUadapt) from InfluenzaB__AGX20518__NA

SEQ ID NO: 29622 - RNA, 1401 nt, Artificial Sequence
  derived and/or modified CDS sequence (AUadapt) from InfluenzaB__AGX20529__NA
augcugcccaguaccauccagacccucacgcuguuccugaccuccggcggggugcuccugagccuguacgucuccgcccuccugagcuaccugcucuacuccgauauccugcugaaguucagcccgaccgagaucaccgcccccacgaugucccucgacugcgcgaacgccucgaacgugcaggccgugaaucgcuccgccaccaagggcgucaccuuccugcugcccgagcccgaguggaccuacccgcggcucagcugccccggguccacguuccagaaggcccugcugaucagcccccaccgcuuuggcgagaccaaggggaacuccgcgccccucaucauccgggagccguucaucgccugcggccccaacgagugcaagcacuucgcccugacccauuacgccgcgcagcccggcggguacuacaacggcacccgcggggaccggaacaagcugcgccaccucaucagugugaagcugggcaagauccccacgguggagaacuccaucuuccacauggccgccuggagcggguccgccugccacgauggcaaggaguggaccuacaucggcgucgacgggccggacaacgacgcccugcucaaggugaaguacggcgaggcguacaccgauaccuaccacucguacgccaacaagauccugcggacgcaggaguccgccugcaacuguaucgggggcaacugcuaccugaugaucaccgacggcagcgccagcgggguguccgagugccgcuuucucaagauccgggagggccgcaucaucaaggagaucuuccccaccgggcgggucaagcacaccgaggagugcacgugcggcuucgccagcaacaagaccaucgaguguacgugccgcgacaacuccuacaccgcgaagcggcccuucgugaagcugaacguggagaccgauaccgccgagauccgccugaugugcaccgacaccuaccucgacacgccccggccggacgacgggagcaucaccggccccugugaguccaacggcgacaaggggucgggcgggaucaagggcggguucguccaccagcgcauggaguccaagaucggccggugguacagccgcaccauguccaagaccgagcggaugggcauggggcuguaugugaaguacgacggcgaccccugggccgacagcgacgcccuggccuucuccggggugauggucaguaugaaggagcccggcugguacuccuucggguucgagaucaaggacaagaagugcgacgugccgugcaucggcaucgagauggugcaugacggcgggaaggagacguggcacagcgcggccaccgccaucuacugccucaugggcuccgggcagcugcugugggacaccgucaccggcguggacauggcccucuga

SEQ ID NO: 29623 - RNA, 1401 nt, Artificial Sequence; identical to SEQ ID NO: 29586
  derived and/or modified CDS sequence (AUadapt) from InfluenzaB__AGX20540__NA

SEQ ID NO: 29624 - RNA, 1401 nt, Artificial Sequence; identical to SEQ ID NO: 29232
  derived and/or modified CDS sequence (AUadapt) from InfluenzaB__AGX20551__NA

SEQ ID NO: 29625 - RNA, 1401 nt, Artificial Sequence; identical to SEQ ID NO: 28985
  derived and/or modified CDS sequence (AUadapt) from InfluenzaB__AGX20562__NA

SEQ ID NO: 29626 - RNA, 1401 nt, Artificial Sequence; identical to SEQ ID NO: 28662
  derived and/or modified CDS sequence (AUadapt) from InfluenzaB__AGX20573__NA

SEQ ID NO: 29627 - RNA, 1401 nt, Artificial Sequence
  derived and/or modified CDS sequence (AUadapt) from InfluenzaB__AGX20584__NA
augcugcccaguaccauccagacccucacgcuguuccugaccuccggcggggugcuccugagccuguacgucuccgccagccucuccuaccugcuguacagugacauccuccugaaguucuccagcaccgagaucaccgccccgacgaugccccuggacugcgcgaacgccuccaacgugcaggccgugaaucgcagcgccaccaagggcgucacccuccugcugcccgagcccgaguggaccuacccgcggcucuccugccccgggucgacguuccagaaggcccugcugaucagcccccaccgcuuuggcgagaccaaggggaacuccgcgccccucaucauccgggagccguucaucgccugcggccccaacgagugcaagcacuucgcccugacccauuacgccgcgcagcccggcggguacuacaacggcacccgcggggaccggaacaagcugcgccaccucaucuccgugaagcugggcaagauccccacgguggagaauagcaucuuccacauggccgccugguccgggagcgccugccacgauggcaaggaguggaccuacaucggcgucgacgggccggacaacaacgcccugcucaaggugaaguacggcgaggcguacaccgauaccuaccacuccuacgccaacaagauccugcggacgcaggagucggccugcaacuguaucgggggcaacugcuaccugaugaucaccgacggcagcgccuccggggugagcgagugccgcuuucucaagauccgggagggccgcaucaucaaggagaucuuccccaccgggcgggucaagcacaccgaggagugcacgugcggcuucgccuccaacaagaccaucgagugcgcgugucgcgacaacucguacaccgccaagcggcccuucgugaagcugaacguggagaccgauacggccgagauccgccugaugugcaccgacaccuaccucgacacgccccggccgaacgacggguccaucaccggccccugcgagaguaacggcgacaagggguccggcgggaucaagggcggguucguccaccagcgcauggagagccggaucggccgcugguacucccggaccaugucgaagaccgagcgcaugggcauggggcuguaugugaaguacgacggcgaccccuggaccgacuccgacgcccugacguucagcggggugauggucuccaugaaggagcccggcugguauagcuucggguucgagaucaaggacaagaagugcgacgugccgugcaucggcaucgagauggugcaugacggcgggaaggagaccuggcacuccgccgcgaccgccaucuacugccucaugggcagcgggcagcugcugugggacaccgucacgggcguggacauggcccucuga

SEQ ID NO: 29628 - RNA, 1401 nt, Artificial Sequence; identical to SEQ ID NO: 28662
  derived and/or modified CDS sequence (AUadapt) from InfluenzaB__AGX20595__NA

SEQ ID NO: 29629 - RNA, 1401 nt, Artificial Sequence; identical to SEQ ID NO: 29586
  derived and/or modified CDS sequence (AUadapt) from InfluenzaB__AGX20606__NA

SEQ ID NO: 29630 - RNA, 1401 nt, Artificial Sequence; identical to SEQ ID NO: 29586
  derived and/or modified CDS sequence (AUadapt) from InfluenzaB__AGX20617__NA

SEQ ID NO: 29631 - RNA, 1401 nt, Artificial Sequence; identical to SEQ ID NO: 29613
  derived and/or modified CDS sequence (AUadapt) from InfluenzaB__AGX20628__NA

SEQ ID NO: 29632 - RNA, 1401 nt, Artificial Sequence; identical to SEQ ID NO: 29013
  derived and/or modified CDS sequence (AUadapt) from InfluenzaB__AGX20639__NA

SEQ ID NO: 29633 - RNA, 1401 nt, Artificial Sequence
  derived and/or modified CDS sequence (AUadapt) from InfluenzaB__AGX20650__NA
augcugcccaguaccauccagacccucacgcuguuccugaccuccggcggggugcuccugagccuguacgucuccgcccuccugagcuaccugcucuacuccgauauccugcugaaguucagcccgaccgagaucaccgcccccacgaugucccucgacugcgcgaacgccucgaacgugcaggccgugaaucgcuccgccaccaagggcgucaccuuccugcugcccgagcccgaguggaccuacccgcggcucagcugccccggguccacguuccagaaggcccugcugaucagcccccaccgcuuuggcgagaccaaggggaacuccgcgccccucaucauccgggagccguucaucgccugcggccccaacgagugcaagcacuucgcccugacccauuacgccgcgcagcccggcggguacuacaacggcacccgcggggaccggaacaagcugcgccaccucaucagugugaagcugggcaagauccccacgguggagaacuccaucuuccacauggccgccuggagcggguccgccugccacgauggcaaggaguggaccuacaucggcgucgacgggccggacaacgacgcccugcucaaggugaaguacggcgaggcguacaccgauaccuaccacucguacgccaacaagauccugcggacgcaggaguccacgugcaacuguaucgggggcaacugcuaccugaugaucaccgacggcagcgccagcgggguguccgagugccgcuuucucaagauccgggagggccgcaucaucaaggagaucuuccccaccgggcgggucaagcacaccgaggagugcacgugcggcuucgccagcaacaagaccaucgagugugccugccgcgacaacuccuacaccgcgaagcggcccuucgugaagcugaacguggagaccgauaccgccgagauccgccugaugugcaccgacaccuaccucgacacgccccggccggacgacgggagcaucaccggccccugugaguccaacggcgacaaggggucgggcgggaucaagggcggguucguccaccagcgcauggaguccaagaucggccggugguacagccgcaccauguccaagaccgagcggaugggcauggggcuguaugugaaguacgacggcgaccccugggccgacagcgacgcccuggccuucuccggggugauggucaguaugaaggagcccggcugguacuccuucggguucgagaucaaggacaagaagugcgacgugccgugcaucggcaucgagauggugcaugacggcgggaaggagacguggcacagcgcggccaccgccaucuacugccucaugggcuccgggcagcugcugugggacaccgucaccggcguggacauggcccucuga

SEQ ID NO: 29634 - RNA, 1401 nt, Artificial Sequence
  derived and/or modified CDS sequence (AUadapt) from InfluenzaB__AGX20661__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaacgugcaggccgugaaucgcuccgccaccaagggcgucacccuccugcugcccgagccggaguggaccuacccccggcucagcugccccggguccacguuccagaaggcccugcugaucucgccccaccgcuucggcgagaccaaggggaauuccgcgccgcucaucauccgggagcccuucaucgccugcggccccaacgagugcaagcacuucgcccugacccacuaugccgcgcagcccggcggguacuacaacggcacccgcggggaccggaacaagcugcgccaccucaucagcgugaaucugggcaagaucccgacgguggagaacuccaucuuccacauggccgccuggagcggguccgccugccacgacggcaaggaguggaccuauaucggcgucgacgggcccgacaacaacgcccugcucaaggugaaguacggcgaggcguacaccgacaccuaucacucguacgccaacaacauccugcggacgcaggaguccgccugcaacuguaucgggggcaacugcuaccugaugaucaccgacggcagcgccagcgggguguccgagugucgcuuccucaagauccgggagggccgcaucaucaaggagaucuuccccaccgggcgggucaagcacaccgaggagugcacgugcggcuucgccucgaauaagaccaucgagugcgcgugccgcgacaacuccuacaccgccaagcggcccuucgugaagcugaacguggagaccgauacggccgagauccgccugaugugcaccgacaccuaccucgacaccccgcggcccaacgacgggagcaucacgggccccugugaguccaacggcgacaaggggagcggcgggaucaagggcggguucguccaccagcgcauggaguccaagaucggccggugguacucgcgcaccauguccaagaccgagcggaugggcauggggcuguaugugaaguacgacggcgaccccuggaccgacagcgacgcccuggccuucuccggggugauggucaguaugaaggagccgggcugguacuccuucggguucgagaucaaggacaagaagugcgacgugcccugcaucggcaucgagauggugcaugacggcgggaaggagacguggcacagcgcggccaccgccaucuacugccucaugggcuccgggcagcugcugugggacaccgucaccggcguggacauggcccucuga

SEQ ID NO: 29635 - RNA, 1401 nt, Artificial Sequence; identical to SEQ ID NO: 29069
  derived and/or modified CDS sequence (AUadapt) from InfluenzaB__AGX20683__NA

SEQ ID NO: 29636 - RNA, 1401 nt, Artificial Sequence; identical to SEQ ID NO: 29232
  derived and/or modified CDS sequence (AUadapt) from InfluenzaB__AGX20694__NA

SEQ ID NO: 29637 - RNA, 1401 nt, Artificial Sequence
  derived and/or modified CDS sequence (AUadapt) from InfluenzaB__AGX20705__NA
augcugcccaguaccauccagacccucacgcuguuccugaccuccggcggggugcuccugagccuguacgucuccgccagccucuccuaccugcuguauagcggcauccuccugaaguucuccccgaccgagaucaccgcccccacgaugccccuggacugcgcgaacgccucggaugugcaggccgugaaccgcuccgccaccaagggggucacccuccugcugcccgagccggaguggaccuacccccggcucagcugccccggcuccacguuccagaaggcccugcugaucagcccccaucgcuucggggagaccaagggcaacuccgcgccgcucaucauccgggagcccuucaucgccugcggccccaacgagugcaagcauuucgcccugacccacuacgccgcgcagcccgggggcuacuacaacgggacccgcggcgaucggaacaagcugcgccaccucaucagcgugaagcuggggaagaucccgacgguggagaacuccaucuuccacauggccgccuggaguggcuccgccugccacgacggcaaggaguggaccuacaucggggucgacggccccgauaacaacgcccugcucaaggugaaguacggggaggcguacaccgacaccuaccauucguacgccaacaagauccugcggacgcaggaguccgccugcaacugcaucggcggcaauugcuaccugaugaucaccgacgggagcgccagcggcguguccgagugccgcuuucucaagauccgggaggggcgcaucaucaaggagaucuuccccaccggccgggucaagcacaccgaggagugcacgugcggguucgccagcaauaagaccaucgagugcgcgugccgcgacaacuccuacaccgccaagcggcccuucgugaagcugaauguggagaccgacacggccgagauccgccugaugugcaccgacaccuaccucgacaccccgcggcccaaugacggcagcaucacgggccccugcgaguccaacggggacaagggcucggggggcaucaagggcggguuuguccaccagcgcauggaguccaagaucggccggugguacagccgcaccauguccaagaccgagcggauggggaugggccuguacgugaaguacgacggggaucccugggccgacagcgacgcccugaccuucuccggcgugauggucagcaugaaggagccggggugguacuccuuuggcuucgagaucaaggacaagaagugcgacgugcccugcaucggcaucgagauggugcacgaugggggcaaggagacguggcacagcgcggccaccgccaucuacugccucaugggguccggccagcugcugugggacaccgucaccggcguggacauggcccucuga

SEQ ID NO: 29638 - RNA, 1401 nt, Artificial Sequence
  derived and/or modified CDS sequence (AUadapt) from InfluenzaB__AGX20716__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccagcaacgugcaggccgugaaccgcuccgccaccaagggcgucacccuccugcugcccgagccggaguggaccuacccccggcucagcugucccggguccacguuccagaaggcccugcugaucagcccccaccgcuucggcgagaccaaggggaacuccgcgccgcucaucauccgggagcccuuuaucgccugcggccccaacgagugcaagcacuucgcccugacccacuaugccgcgcagcccggcggguacuacaacggcacccgcggggaccggaacaagcugcgccaucucaucagcgugaagcugggcaagaucccgacgguggagaacuccaucuuccacauggccgccuggagcggguccgccugucacgacggcaaggaguggaccuacaucggcgucgacgggcccgacaauaacgcccugcucaaggugaaguacggcgaggcguacaccgacaccuaccauucguacgccaacaagauccugcggacgcaggaguccgccugcaacugcaucgggggcaauugcuaccugaugaucaccgacggcagcgccagcgggguguccgagugucgcuuccucaagauccgggagggccgcaucaucaaggagaucuuccccaccgggcgggucaagcacaccgaggagugcacgugcggcuuugccagcaacaagaccaucgagugcgcgugccgcgacaauuccuacaccgccaagcggcccuucgugaagcugaacguggagaccgacacggccgagauccgccugaugugcaccgauaccuaccucgacaccccgcggcccaacgacgggagcaucacgggccccugcgaguccgauggcgacaaggggagcggcgggaucaagggcggguucguccaccagcgcaucgagucccggaucggccgcugguacagucggaccauguccaagaccgagcgcaugggcauggggcuguacgugaaguacgacggcgaccccugggccgacagugacgcccuggcguucuccggggugauggucagcaugaaggagccgggcugguacuccuucggguuugagaucaaggacaagaagugcgacgugcccugcaucggcaucgagauggugcacgauggcgggaaggagaccuggcacagcgccgccacggccaucuacugccucaugggcuccgggcagcugcugugggacaccgucaccggcguggacauggcccucuga

SEQ ID NO: 29639 - RNA, 1401 nt, Artificial Sequence
  derived and/or modified CDS sequence (AUadapt) from InfluenzaB__AGX20727__NA
augcugcccaguaccauccagacccucacgcuguuccugaccuccggcggggugcuccugagccuguacgucuccgcccuccugagcuaccugcucuauuccgacauccugcugaaguucagcccgaccgagaucaccgcccccacgaugucccucgacugcgcgaacgccaguaacgugcaggccgugaaccgcuccgccaccaagggcgucaccuuccugcugcccgagcccgaguggaccuacccgcggcucagcugccccggguccacguuucagaaggcccugcugaucucgccccaccgcuucggcgagaccaaggggaacuccgcgccccucaucauccgggagccguucaucgccugcggccccaaugagugcaagcacuucgcccugacccacuacgccgcgcagcccggcggguacuauaacggcacccgcggggaccggaacaagcugcgccaccucaucagcgugaagcugggcaagauccccacgguggagaacuccaucuuucacauggccgccuggagcggguccgccugccacgacggcaaggaguggaccuacaucggcgucgaugggccggacaacgacgcccugcucaaggugaaguacggcgaggcguacaccgacaccuaucacagcuacgccaacaagauccugcggacgcaggaguccgccugcaacuguaucgggggcaacugcuaccugaugaucaccgacggcagcgccagcgggguguccgagugucgcuuccucaagauccgggagggccgcaucaucaaggagaucuuccccaccgggcgggucaagcacaccgaggagugcacgugcggcuucgccaguaacaagaccaucgagugcgcgugccgcgacaacuccuacaccgccaagcggcccuuugugaagcugaacguggagaccgacacggccgagauccgccugaugugcaccgacaccuaccucgacacgccccggccggaugacgggagcaccaccggccccugcgaguccaacggcgacaaggggagcggcgggaucaagggcggguuuguccaccagcgcauggaguccaagaucggccggugguacagccgcaccauguccaagaccgagcggaugggcauggggcuguacgugaaguacgacggcgaucccugggccgacagcgacgcccuggcguucuccggggugauggucagcaugaaggagcccggcugguacuccuuuggguucgagaucaaggacaagaagugcgacgugccgugcaucggcaucgagauggugcacgauggcgggaaggagacguggcacagcgccgccaccgccaucuacugccucaugggcuccgggcagcugcugugggacaccgucaccggcguggacauggcccucuga

SEQ ID NO: 29640 - RNA, 1401 nt, Artificial Sequence; identical to SEQ ID NO: 29232
  derived and/or modified CDS sequence (AUadapt) from InfluenzaB__AGX20738__NA

SEQ ID NO: 29641 - RNA, 1401 nt, Artificial Sequence; identical to SEQ ID NO: 28662
  derived and/or modified CDS sequence (AUadapt) from InfluenzaB__AGX20749__NA

SEQ ID NO: 29642 - RNA, 1401 nt, Artificial Sequence
  derived and/or modified CDS sequence (AUadapt) from InfluenzaB__AGX20760__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccagcaacgugcaggccgugaaccgcuccgccaccaagggcgucacccuccugcugcccgagccggaguggaccuacccccggcucagcugucccggguccacguuccagaaggcccugcugaucagcccccaccgcuucggcgagaccaaggggaacuccgcgccgcucaucauccgggagcccuuuaucgccugcggccccaacgagugcaagcacuucgcccugacccacuaugccgcgcagcccggcggguacuacaacggcacccgcggggaccggaacaagcugcgccaucucaucagcgugaagcugggcaagaucccgacgguggagaacuccaucuuccacauggccgccuggagcggguccgccugucacgacggcaaggaguggaccuacaucggcgucgacgggcccgacaauaacgcccugcucaaggugaaguacggcgaggcguacaccgacaccuaccauucguacgccaacaagauccugcggacgcaggaguccgccugcaacugcaucgggggcaauugcuaccugaugaucaccgacggcagcgccagcgggguguccgagugucgcuuccucaagauccgggagggccgcaucaucaaggagaucuuccccaccgggcgggucaagcacaccgaggagugcacgugcggcuuugccagcaacaagaccaucgagugcgcgugccgcgacaauuccuacaccgccaagcggcccuucgugaagcugaacguggagaccgacacggccgagauccgccugaugugcaccgauaccuaccucgacaccccgcggcccaacgacgggagcaucacgggccccugcgaguccgauggcgacaaggggagcggcgggaucaagggcggguucguccaccagcgcauggagucccggaucggccgcugguacagucggaccauguccaagaccgagcgcaugggcauggggcuguacgugaaguacgacggcgaccccugggccgacagugacgcccuggcguucuccggggugauggucagcaugaaggagccgggcugguacuccuucggguuugagaucaaggacaagaagugcgacgugcccugcaucggcaucgagauggugcacgauggcgggaaggagaccuggcacagcgccgccacggccaucuacugccucaugggcuccgggcagcugcugugggacaccgucaccggcguggacauggcccucuga

SEQ ID NO: 29643 - RNA, 1401 nt, Artificial Sequence; identical to SEQ ID NO: 28662
  derived and/or modified CDS sequence (AUadapt) from InfluenzaB__AGX20771__NA

SEQ ID NO: 29644 - RNA, 1401 nt, Artificial Sequence
  derived and/or modified CDS sequence (AUadapt) from InfluenzaB__AGX20782__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccacuccgccaccaagggcgucacccuccugcugcccgagccggaguggaccuacccccgccucagcugucccggguccacguuccagaaggcccugcugaucucgucccaccgguucggcgagaccaaggggaacagcgcgccccucaucauccgcgagccguuuguggccugcggccccaacgagugcaagcacuucgcccugacccacuaugccgcgcagcccggcggguacuacaacggcacccgcggggaccggaacaagcugcggcaucucaucuccgugaagcugggcaagauccccacggucgagaacagcaucuuccacauggccgccugguccgggagcgccugccaugacggcaaggaguggaccuacaucggcguggacgggccggacaacaacgcccugcucaaggugaaguauggcgaggcguacaccgacaccuaccacuccuacgccaauaagauccugcgcacgcaggagagcgccugcaacugcaucgggggcaacugcuaucugaugaucaccgacggcagcgccuccggggucagcgagugccgguuccucaagauccgcgagggccggaucaucaaggagaucuuucccaccgggcgcgugaagcacaccgaggagugcacgugcggcuucgccuccaacaagaccaucgagugcgcgugucgggacaacucguacaccgccaagcgccccuucgugaagcugaacgucgagaccgauacggccgagauccggcugaugugcaccgacaccuaccucgacacgccccgcccgaacgauggguccaucaccggccccugcgagagcgacggcgacaagggguccggcgggaucaagggcggguucgugcaccagcggauggagaguaagaucggccgcugguacucccggaccaugagccgcaccgagcggaugggcauggggcuguacgugaaguacgacggcgaccccugggccgauuccgacgcccuggcguucagcggggucaugguguccaugaaggagcccggcugguacagcuuuggguucgagaucaaggacaagaagugcgacgugccgugcaucggcaucgagaugguccacgauggcgggaaggagaccuggcacuccgccgccacggccaucuacugccucaugggcagcgggcagcugcugugggacaccgugaccggcguggacauggcccucuga

SEQ ID NO: 29645 - RNA, 1401 nt, Artificial Sequence
  derived and/or modified CDS sequence (AUadapt) from InfluenzaB__AGX20793__NA
augcugcccaguaccauccagacccucacgcuguuccugaccuccggcggggugcuccugagccuguacgucuccgcccuccugagcuaccugcucuacuccgacauccugcugaaguuuucgccgaccgagaucaccgcccccacgaugucccucgacugcgcgaacaccagcaacgugcaggccgugaaccgcuccgccaccaagggcgucaccuuucugcugcccgagcccgaguggacguacccgcggcucagcugccccggguccaccuuccagaaggcccugcugaucagcccccaccgcuucggcgagaccaaggggaacuccgcgccccucaucauccgggagccguuuaucgccugcggccccaacgagugcaagcacuucgcccugacccacuacgccgcccagcccggcggguauuacaacggcacgcgcggggaccggaacaagcugcgccaccucaucucggugaagcugggcaagauccccaccguggagaacuccaucuuucacauggcggccuggagcggguccgccugccacgacggcaaggaguggaccuacaucggcgucgacgggccggacaaugacgcccugcucaaggugaaguacggcgaggccuacaccgacacguaccacagcuaugcgaacaagauccugcggacccaggaguccgccugcaacugcaucgggggcaacugcuaccugaugaucaccgauggcagcgccucggggguguccgagugccgcuuccucaagauccgggagggccgcaucaucaaggagaucuuccccaccgggcgggucaagcacacggaggagugcacgugcggcuuugccagcaacaagaccaucgagugcgccugccgcgacaacuccuacaccgcgaagcggcccuuugugaagcugaacguggagaccgacaccgccgagauccgccugaugugcaccgacaccuaccucgacacgccccggccggacgaugggagcaucaccggccccugcgaguccaacggcgacaaggggagcggcgggaucaagggcggguucguccaccagcgcauggaguccaagaucggccggugguacagucgcaccauguccaagaccgagcggaugggcauggggcuguacgugaaguacgacggcgaccccugggccgacagcgacgcccuggccuuuuccggggugauggucagcaugaaggagcccggcugguacuccuucggguucgagaucaaggacaagaagugcgacgugccguguaucggcaucgagauggugcacgacggcgggaaggagacguggcacagcgcggccaccgccaucuacugccucaugggcuccgggcagcugcugugggacaccgucaccggcgugaacauggcccucuga

SEQ ID NO: 29646 - RNA, 1401 nt, Artificial Sequence
  derived and/or modified CDS sequence (AUadapt) from InfluenzaB__AGX20804__NA
augcugcccaguaccauccagacccucacgcuguucaucaccuccggcggggugcugcucagccuguacgucuccgcccugcucagcuaccugcuguacuccgauauccuccugaaguucagcccgaccgagaucaccgcccccacgaugucccuggacugcgcgaacgccucgaacgugcaggccgugaaucgcuccgccaccaagggcgucaccuuccuccugcccgagcccgaguggaccuacccgcggcugagcugccccggguccacguuccagaaggcccuccugaucagcccccaccgcuuuggcgagaccaaggggaacuccgcgccccugaucauccgggagccguucaucgccugcggccccaacgagugcaagcacuucgcccucacccauuacgccgcgcagcccggcggguacuacaacggcacccgcggggaccggaacaagcugcgccaccugaucagugugaagcucggcaagauccccacgguggagaacuccaucuuccacauggccgccuggagcggguccgccugccacgauggcaaggaguggaccuacaucggcgucgacgggccggacaacgacgcccugcugaaggugaaguacggcgaggcguacaccgauaccuaccacucguacgccaacaagauccuccggacgcaggaguccgccugcaacuguaucgggggcaacugcuaccugaugaucaccgacggcagcgccagcgggguguccgagugccgcuuucugaagauccgggagggccgcaucaucaaggagaucuuccccaccgggcgggucaagcacaccgaggagugcacgugcggcuucgccagcaacaagaccaucgagugugcgugccgcgacaacuccuacaccgccaagcggcccuucgugaagcucaacguggagaccgauacggccgagauccgccugaugugcaccgacaccuaccuggacacgccccggccggacgacgggagcaucaccggccccugugaguccaacggcgacaaggggucgggcgggaucaagggcggguucguccaccagcgcauggaguccaagaucggccggugguacagccgcaccauguccaagaccgagcggaugggcauggggcucuaugugaaguacgacggcgaccccugggccgacagcgacgcccuggcguucuccggggugauggucaguaugaaggagcccggcugguacuccuucggguucgagaucaaggacaagaagugcgacgugccgugcaucggcaucgagauggugcaugacggcgggaaggagaccuggcacagcgccgccacggccaucuacugccugaugggcuccgggcagcuccugugggacaccgucaccggcguggacauggcccuguga

SEQ ID NO: 29647 - RNA, 1401 nt, Artificial Sequence; identical to SEQ ID NO: 29069
  derived and/or modified CDS sequence (AUadapt) from InfluenzaB__AGX20815__NA

SEQ ID NO: 29648 - RNA, 1401 nt, Artificial Sequence; identical to SEQ ID NO: 29069
  derived and/or modified CDS sequence (AUadapt) from InfluenzaB__AGX20826__NA

SEQ ID NO: 29649 - RNA, 1401 nt, Artificial Sequence; identical to SEQ ID NO: 29069
  derived and/or modified CDS sequence (AUadapt) from InfluenzaB__AGX20837__NA

SEQ ID NO: 29650 - RNA, 1401 nt, Artificial Sequence; identical to SEQ ID NO: 29069
  derived and/or modified CDS sequence (AUadapt) from InfluenzaB__AGX20848__NA

SEQ ID NO: 29651 - RNA, 1401 nt, Artificial Sequence
  derived and/or modified CDS sequence (AUadapt) from InfluenzaB__AGX20870__NA
augcugcccaguaccauccagaugcucacccuguuccugacguccggcggggugcuccugagccuguacgucuccgccagccucuccuaccugcuguacagugacauccuccugaaguucuccccgaccgagaucaccgcccccaccaugccccuggacugcgcgaacgccagcaacgugcaugccgugaaccgcuccgccacgaagggcgucaccuuccuccugcccgagccggaguggaccuacccccggcugagcugccccggguccaccuuccagaaggcccuccugaucucgccccaucgcuucggcgagacgaaggggaacuccgcgccgcugaucauccgggagcccuucaucgccugcggccccaacgagugcaagcacuuugcccucacccacuacgccgcgcagcccggcggguacuacaacggcacccgcggggaccggaacaagcugcgccaucugaucagcgugaagcucggcaagaucccgaccguggagaacuccaucuuccacauggccgccuggagcggguccgccugccacgauggcaaggaguggacguacaucggcgucgacgggcccgacaacaacgcccugcugaagaucaaguacggcgaggcguacaccgauaccuaccacucguacgccaacaacauccuccggacccaggaguccgccugcaauugcaucgggggcaacugcuaccugaugaucacggacggcagcgccagugggguguccgagugccgcuuccugaagauccgggagggccgcaucaucaaggagaucuuccccaccgggcgggugaagcacaccgaggagugcacgugcggcuucgccaguaacaagaccaucgagugcgcgugccgcgacaacuccuacaccgccaagcggcccuucgucaagcucaauguggagaccgacaccgccgagauccgccugaugugcacggacaccuaccuggacaccccgcggcccgacgacgggaguaucaccggccccugcgaguccaacggcgacaaggggagcggcgggaucaagggcggguucgugcaccagcgcauggccuccaagaucggccggugguacagucgcacgauguccaagaccgagcggaagggcauggggcucuacgucaaguacgacggcgagcccuggaccgacagcgacgcccuggcguuccgcggggugaugguguccaugaaggagccgggcugguauagcuucggguucgagaucaaggacaagaagugcgacguccccugcaucggcaucgagauggugcaugacggcgggaaggagaccuggcacuccgccgccacggccaucuacugccugaugggcagcgggcagcuccugugggacaccgugaccggcgucgacauggcccuguga

SEQ ID NO: 29652 - RNA, 1401 nt, Artificial Sequence
  derived and/or modified CDS sequence (AUadapt) from InfluenzaB__AGX20881__NA
augcugcccaguaccauccagaugcucacccuguuccugacguccggcggggugcuccugagccuguacgucuccgccucgcucuccuaccugcuguacagcgauauccuccugaaguucuccccgaccgagaucaccgcccccaccaugccccuggacugcgcgaacgccagcaacgugcacgccgugaaucgcuccgccacgaagggcgucaccuuccuccugcccgagccggaguggaccuacccccggcugucgugccccggguccaccuuccagaaggcccuccugaucagcccccaccgcuucggcgagacgaaggggaauuccgcgccgcugaucauccgggagcccuucaucgccugcggccccaacgagugcaagcacuucgcccucacccacuaugccgcgcagcccggcggguacuacaacggcacccgcgggaaccggaacaagcugcgccaccugaucagcgugaagcucggcaagaucccgaccguggagaacuccaucuuucacauggccgccuggucgggguccgccugccacgacggcaaggaguggacguacaucggcgucgacgggcccgauaacaacgcccugcugaagaucaaguacggcgaggcguacaccgacaccuaccacagcuaugccaacaacauccuccggacccaggaguccgccugcaacugcaucgggggcaacugcuaucugaugaucacggacggcucggccagcgggguguccgagugccgcuuccugaagauccgggagggccgcaucaucaaggagaucuuccccaccgggcgggugaagcacaccgaggagugcacguguggcuucgccagcaacaagaccaucgagugcgcgugccgcgacaacuccuauaccgccaagcggcccuucgucaagcucaacguggagaccgacaccgccgagauccgccugaugugcacggacaccuaccuggacaccccgcggcccgacgaugggucgaucaccggccccugcgaguccaacggcgacaaggggagcggcgggaucaagggcggguucgugcaccagcgcauggccuccaagaucggccggugguauagccgcacgauguccaagaccgagcggaagggcauggggcucuacgucaaguacgacggcgaccccuggaccgacucggacgcccuggcguuucgcggggugaugguguccaugaaggagccgggcugguacagcuucggguucgagaucaaggacaagaagugcgacguccccuguaucggcaucgagauggugcacgacggcgggaaggagaccuggcacuccgccgccacggccaucuacugccugaugggcagcgggcagcuccugugggacaccgugaccggcgucgacauggcccuguga

SEQ ID NO: 29653 - RNA, 1401 nt, Artificial Sequence
  derived and/or modified CDS sequence (AUadapt) from InfluenzaB__AGX20892__NA
augcugcccaguaccauccagacccucacgcuguuccugaccuccggcggggugcuccugagccuguacgucuccgcccuccugagcuaucugcucuacuccgacauccugcugaaguucagcccgaccgagaucaccgcccccacgaugucccucgacugugcgaacgccagcaacgugcaggccgugaaccgcuccgccaccaagggcgucaccuuccugcugcccgagcccgaguggaccuauccgcggcucagcugccccggguccacguuccagcgcgcccugcugaucagcccccaccgguuuggcgaggcgaaggggaacuccgcgccccucaucauccgcgagccguucaucgccugcggccccaacgagugcaagcauuucgcccugacccacuacgccgcccagcccggcggguacuacaauggcacccgcggggaccggaacaagcugcggcaccucaucagcgugaagcugggcaagauccccaccguggagaacuccaucuuucacauggccgccuggagcggguccgccugccacgacggcaaggaguggacguauaucggcgucgacgggccggacaacgacgcgcugcucaaggugaaguacggcgaggccuauaccgacaccuaccacagcuacgccaauaagauccugcgcacccaggaguccgccugcaacugcaucgggggcaacuguuaccugaugaucacggacggcagcgccagcgggguguccgagugccgguuucucaagauccgcgagggccggaucaucaaggagauccugcccaccgggcgcgucaagcacaccgaggagugcacgugcggcuucgcgagcaauaagaccaucgagugcgccugccgggacaacuccuacaccgccaagcgccccuuugugaagcugaacguggagaccgacaccgccgagauccggcucaugugcacggacaccuaccuggauacgccccgcccggacgacgggagcaucaccggccccugcgaguccaacggcgauaaggggagcggcgggaucaagggcggguucguccaccagcggauggaguccaagaucggccgcugguacagccggaccauguccaagaccgagcgcaugggcauggggcuguaugugaaguacgacggcgaccccugggccgacagcgaugcgcucgccuucuccggggugauggucagcaugaaggagcccggcugguacuccuucggguucgagaucaaggauaagaagugcgacgugccgugcaucggcaucgagauggugcacgacggcgggaaggagaccuggcauagcgccgccaccgccaucuacugccugaugggcuccgggcagcugcucugggacacggucaccggcguggacauggcgcuguga

SEQ ID NO: 29654 - RNA, 1401 nt, Artificial Sequence; identical to SEQ ID NO: 29069
  derived and/or modified CDS sequence (AUadapt) from InfluenzaB__AGX20903__NA

SEQ ID NO: 29655 - RNA, 1401 nt, Artificial Sequence; identical to SEQ ID NO: 29069
  derived and/or modified CDS sequence (AUadapt) from InfluenzaB__AGX20914__NA

SEQ ID NO: 29656 - RNA, 1401 nt, Artificial Sequence
  derived and/or modified CDS sequence (AUadapt) from InfluenzaB__AGX20925__NA
augcugcccaguaccauccagacccucacgcuguuccugaccuccggcggggugcuccugagccuguacgucuccgcccuccugagcuaccugcucuacuccgauauccugcugaaguucagcccgaccgagaucaccgcccccacgaugucccucgacugcgcgaacgccucgaacgugcaggccgugaaucgcuccgccaccaagggcgucaccuuccugcugcccgagcccgaguggaccuacccgcggcucagcugccccggguccacguuccagaaggcccugcugaucagcccccaccgcuuuggcgagaccaaggggaacuccgcgccccucaucauccgggagccguucaucgccugcggccccaacgagugcaagcacuucgcccugacccauuacgccgcgcagcccggcggguacuacaacggcacccgcggggaccggaacaagcugcgccaccucaucagugugaagcugggcaagauccccacgguggagaacuccaucuuccacauggccgccuggagcggguccgccugccacgauggcaaggaguggaccuacaucggcgucgacgggccggacaacgacgcccugcucaaggugaaguacggcgaggcguacaccgauaccuaccacucguacgccaacaagauccugcggacgcaggaguccgccugcaacuguaucgggggcaacugcuaccugaugaucaccgacggcagcgccagcgggguguccgagugccgcuuucucaagauccaggagggccggaucaucaaggagaucuuccccaccgggcgcgucaagcacaccgaggagugcacgugcggcuucgccagcaacaagaccaucgagugugcgugccgggacaacuccuacaccgccaagcgccccuucgugaagcugaacguggagaccgauacggccgagauccggcugaugugcaccgacaccuaccucgacacgccccgcccggacgacgggagcaucaccggccccugugaguccaacggcgacaaggggucgggcgggaucaagggcggguucguccaccagcggauggaguccaagaucggccgcugguacagccggaccauguccaagaccgagcgcaugggcauggggcuguaugugaaguacgacggcgaccccugggccgacagcgacgcccuggcguucuccggggugauggucaguaugaaggagcccggcugguacuccuucggguucgagaucaaggacaagaagugcgacgugccgugcaucggcaucgagauggugcaugacggcgggaaggagaccuggcacagcgccgccacggccaucuacugccucaugggcuccgggcagcugcugugggacaccgucaccggcguggacauggcccucuga

SEQ ID NO: 29657 - RNA, 1401 nt, Artificial Sequence
  derived and/or modified CDS sequence (AUadapt) from InfluenzaB__AGX20936__NA
augcugcccaguaccauccagacccucacgcuguuccugaccuccggcggggugcuccugagccuguacgucuccgcccuccugagcuaccugcucuacuccgauauccugccgaaguucagccccaccgagaucaccgcccccacgaugucccuggacugcgcgaacgccagcaaugugcaggccgugaaccgcuccgccaccaagggcgucaccuuccuccugcccgagccggaguggaccuacccccggcugagcugccccggguccacguuccagaaggcccuccugaucucgccccaucgcuucggcgagaccaaggggaacuccgcgccgcugaucauccgggagcccuucaucgccugcggccccaacgagugcaagcauuucgcccucacccacuacgccgcgcagcccggcggguacuacaacggcacccgcggggaucggaacaagcugcgccaccugaucagcgugaagcucggcaagaucccgacgguggagaacuccaucuuccacauggccgccuggagcggguccgccugucacgacggcaaggaguggaccuacaucggcgucgacgggcccgacaacgaugcccugcugaaggugaaguacggcgaggcguacaccgacaccuaccacagcuaugccaacaagauccuccggacgcaggaguccgccugcaacugcaucgggggcaacugcuaccugaugaucaccgauggcagcgccagcgggguguccgagugccgcuuccugaagauccgggagggccgcaucaucaaggagaucuuccccaccgggcgggucaagcacaccgaggaguguacgugcggcuucgccucgaacaagaccaucgagugcgcgugccgcgauaacuccuacaccgccaagcggcccuucgugaagcucaacguggagaccgacacggccgagauccgccugaugugcaccgacaccuaucuggacaccccgcggcccgacgacgggagcaucacgggccccugcgaguccaacggcgauaaggggagcggcgggaucaagggcggguucguccaccagcgcauggaguccaagaucggccggugguacagccgcaccauguccaagaccgagcggaugggcauggggcucuacgugaaguaugacggcgaccccugggccgacagcgacgcccugguguucuccggggucauggugagcaugaaggagccgggcugguauuccuucggguucgagaucaaggacaagaagugcgacgugcccugcaucggcaucgagaugguccaugacggcgggaaggagaccuggcacagcgcggccacggccaucuacugccugaugggcuccgggcagcuccugugggacaccgugaccggcguggacauggcccuguga

SEQ ID NO: 29658 - RNA, 1401 nt, Artificial Sequence; identical to SEQ ID NO: 28662
  derived and/or modified CDS sequence (AUadapt) from InfluenzaB__AGX20947__NA

SEQ ID NO: 29659 - RNA, 1401 nt, Artificial Sequence
  derived and/or modified CDS sequence (AUadapt) from InfluenzaB__AGX20958__NA
augcugcccaguaccauccagacccucacgcuguuccugaccuccggcggggugcuccugagccuguacgucuccgcccuccugagcuaccugcucuacuccgacauccugcugaaguuuucgccgaccgagaucaccacgcccaccaugucccucgacugcaccaacgccagcaacgugcaggcggugaaccgcuccgccaccaagggcgucacguuccugcugcccgagcccgaguggaccuauccgcggcucagcugccccggguccaccuuccagaaggcccugcugaucucgccccaccgcuucggcgagaccaaggggaacuccgcgccccucaucauccgggagccguucaucgccuguggccccaacgagugcaagcacuucgcccugacgcacuacgccgcccagcccggcggguacuacaauggcacccgcggggaccggaacaagcugcgccaccucaucagcgugaagcugggcaagauccccaccguggagaacuccaucuuccacauggccgcguggagcggguccgccugucacgacggcaaggaguggaccuacaucggcgucgacgggccggacaacgacgcccugcucaaggugaaguacggcgaggccuauacggacaccuaccacucguacgccaacaagauccugcggacccaggaguccgcgugcaacuguaucgggggcaacugcuaccugaugaucaccgacggcagcgccagcgggguguccgagugccgcuuccucaagauccaggagggccggaucaucaaggagaucuuucccacggggcgcgucaagcacaccgaggagugcacgugcggcuucgccucgaacaagaccaucgagugcgccugccgggauaacuccuacaccgccaagcgccccuucgugaagcugaacguggagaccgacaccgcggagauccggcugaugugcaccgacacguaccucgauacgccccgcccggacgacgggagcaucaccggccccugcgaguccaacggcgacaaggggagcggcgggaucaagggcggguucguccaucagcggauggaguccaagaucggccgcugguacucgcggaccauguccaagaccgagcgcaugggcauggggcuguacgugaaguacgacggcgaccccugggccgacagcgaugcccuggccuucuccggggugauggucagcaugaaggagcccggcugguacuccuucggguucgagaucaaggacaagaagugcgacgugccguguaucggcaucgagauggugcacgacggcgggaaggagaccuggcacagcgccgcgaccgccaucuacugccucaugggcuccgggcagcugcugugggacaccgucacgggcguggacauggcccucuga

SEQ ID NO: 29660 - RNA, 1401 nt, Artificial Sequence; identical to SEQ ID NO: 29232
  derived and/or modified CDS sequence (AUadapt) from InfluenzaB__AGX20969__NA

SEQ ID NO: 29661 - RNA, 1401 nt, Artificial Sequence; identical to SEQ ID NO: 29645
  derived and/or modified CDS sequence (AUadapt) from InfluenzaB__AGX20980__NA

SEQ ID NO: 29662 - RNA, 1401 nt, Artificial Sequence
  derived and/or modified CDS sequence (AUadapt) from InfluenzaB__AGX20991__NA
augcugcccaguaccauccagacccucacgcuguuccugaccuccggcggggugcuccugagccuguacgucuccgcccuccugagcuaccugcucuacuccgauauccugccgaaguucagccccaccgagaucaccgcccccacgaugucccuggacugcgcgaacgccucgaacgugcaggccgugaaucgcuccgccaccaagggcgucaccuuccuccugcccgagccggaguggaccuacccccggcugagcugccccggguccacguuccagaaggcccuccugaucagcccccaccgcuuuggcgagaccaaggggaacuccgcgccgcugaucauccgggagcccuucaucgccugcggccccaacgagugcaagcacuucgcccucacccauuacgccgcgcagcccggcggguacuacaacggcacccgcggggaccggaacaagcugcgccaccugaucagugugaagcucggcaagaucccgacgguggagaacuccaucuuccacauggccgccuggagcggguccgccugccacgauggcaaggaguggaccuacaucggcgucgacgggcccgacaacgacgcccugcugaaggugaaguacggcgaggcguacaccgauaccuaccacucguacgccaacaagauccuccggacgcaggaguccgccugcaacuguaucgggggcaacugcuaccugaugaucaccgacggcagcgccagcgggguguccgagugccgcuuucugaagauccggaagggccgcaucaucaaggagaucuuccccaccgggcgggucaagcacaccgaggagugcacgugcggcuucgccagcaacaagaccaucgagugugcgugccgcgacaacuccuacaccgccaagcggcccuucgugaagcucaacguggagaccgauacggccgagauccgccugaugugcaccgacaccuaccuggacaccccgcggcccgacgacgggagcaucacgggccccugugaguccaacggcgacaaggggucgggcgggaucaagggcggguucguccaccagcgcauggaguccaagaucggccggugguacagccgcaccauguccaagaccgagcggaugggcauggggcucuaugugaaguacgacggcgaccccugggccgacagcgacgcccugguguucuccggggucauggugaguaugaaggagccgggcugguacuccuucggguucgagaucaaggacaagaagugcgacgugcccugcaucggcaucgagaugguccaugacggcgggaaggagaccuggcacagcgcggccacggccaucuacugccugaugggcuccgggcagcuccugugggacaccgugaccggcguggacauggcccuguga

SEQ ID NO: 29663 - RNA, 1401 nt, Artificial Sequence; identical to SEQ ID NO: 29069
  derived and/or modified CDS sequence (AUadapt) from InfluenzaB__AGX21002__NA

SEQ ID NO: 29664 - RNA, 1401 nt, Artificial Sequence
  derived and/or modified CDS sequence (AUadapt) from InfluenzaB__AGX21013__NA
augcugcccaguaccauccagacccucacgcuguuccugaccuccggcggggugcuccugagccuguacgucuccgcccuccugagcuaccugcucuacuccgauauccugcugaaguucagcccgaccgagaucaccgcccccacgaugucccucgacugcgcgaacgccucgaacgugcaggccgugaaucgcuccgccaccaagggcgucaccuuccugcugcccgagcccgaguggaccuacccgcggcucagcugccccggguccacguuccagaaggcccugcugaucagcccccaccgcuuuggcgagaccaaggggaacuccgcgccccucaucauccgggagccguucaucgccugcggccccaacgagugcaagcacuucgcccugacccauuacgccgcgcagcccggcggguacuacaacggcacccgcggggaccggaacaagcugcgccaccucaucagugugaagcugggcaagauccccacgguggagaacuccaucuuccacauggccgccuggagcggguccgccugccacgauggcaaggaguggaccuacaucggcgucgacgggccggacaacgacgcccugcucaaggugaaguacggcgaggcguacaccgauaccuaccacucguacgccaacaagauccugcggacgcaggaguccgccugcaacuguaucgggggcaacugcuaccugaugaucaccgacggcagcgccagcgggguguccgagugccgcuuucucaagauccgggagggccgcaucaucaaggagaucuuccccaccgggcgggucaagcacaccgaggagugcacgugcggcuucgccagcaacaagaccaucgagugugcgugccgcgacaacuccuacaccgccaagcggcccuucgugaagcugaacguggagaccgauacggccgagauccgccugaugugcaccaacaccuaccucgacacgccccggccggacgacgggagcaucaccggccccugugaguccaacggcgacaaggggucgggcgggaucaagggcggguucguccaccagcgcauggaguccaagaucggccggugguacagccgcaccauguccaagaccgagcggaugggcauggggcuguaugugaaguacgacggcgaccccugggccgacagcgacgcccuggcguucuccggggugauggucaguaugaaggagcccggcugguacuccuucggguucgagaucaaggacaagaagugcgacgugccgugcaucggcaucgagauggugcaugacggcgggaaggagaccuggcacagcgccgccacggccaucuacugccucaugggcuccgggcagcugcugugggacaccgucaccggcguggacauggcccucuga

SEQ ID NO: 29665 - RNA, 1401 nt, Artificial Sequence
  derived and/or modified CDS sequence (AUadapt) from InfluenzaB__AGX21024__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccgcuccgccaccaagggcgucacccuccugcugcccgagccggaguggaccuacccccggcucagcugccccggguccacguuccagaaggcccugcugaucagccccaaucgcuucggcgagaccaaggggaacuccgcgccgcucaucauccgggagcccuucaucgccugcggccccaacgagugcaagcacuuugcccugacccacuacgccgcgcagcccggcggguacuacaacggcacccgcggggaccggaauaagcugcgccaccucaucucggugaagcugggcaagaucccgacgguggagaacuccaucuuccacauggccgccuggagcggguccgccugucacgacggcaaggaguggaccuacaucggcgucgacgggcccgacaacaacgcccugcucaaggugaaguauggcgaggcguacaccgacaccuaccacagcuacgccaauaagauccugcggacgcaggaguccgccugcaacugcaucgggggcaacugcuaccugaugaucaccgauggcagcgccucggggguguccgagugccgcuuccucaagauccgggagggccgcaucaucaaggagaucuuccccaccgggcgggucaagcacaccgaggaguguacgugcggcuucgccagcaacaagaccaucgagugcgcgugccgcgacaauuccuacaccgccaagcggcccuucgugaagcugaacguggagaccgacacggccgagguccgccugaugugcaccgacaccuaucucgacaccccgcggcccaacgacgggagcaucacgggccccugcgaguccgacggcgauaaggggagcggcgggaucaagggcggguucgugcaccagcgcauggaguccaagaucggccggugguacucgcgcaccauguccaagaccgagcggaugggcauggggcuguacgugaaguacgauggcgaccccugggccgacagcgacgcccugaccuucuccggggucauggugagcaugaaggagccgggcugguauuccuucggguucgagaucaaggacaagaagugcgacgugcccugcaucggcaucgagaugguccaugacggcgggaaggagacguggcacagcgcggccaccgccaucuacugccucaugggcuccgggcagcugcugugggacaccgugaccggcguggacauggcccucuga

SEQ ID NO: 29666 - RNA, 1401 nt, Artificial Sequence; identical to SEQ ID NO: 29069
  derived and/or modified CDS sequence (AUadapt) from InfluenzaB__AGX21035__NA

SEQ ID NO: 29667 - RNA, 1401 nt, Artificial Sequence; identical to SEQ ID NO: 29232
  derived and/or modified CDS sequence (AUadapt) from InfluenzaB__AGX21046__NA

SEQ ID NO: 29668 - RNA, 1401 nt, Artificial Sequence; identical to SEQ ID NO: 29235
  derived and/or modified CDS sequence (AUadapt) from InfluenzaB__AGX21057__NA

SEQ ID NO: 29669 - RNA, 1401 nt, Artificial Sequence; identical to SEQ ID NO: 29653
  derived and/or modified CDS sequence (AUadapt) from InfluenzaB__AGX21068__NA

SEQ ID NO: 29670 - RNA, 1401 nt, Artificial Sequence
  derived and/or modified CDS sequence (AUadapt) from InfluenzaB__AGX21079__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccgcgaugccccuggacugcgccaaugccagcaacgugcaggccgugaaccgcuccgccacgaagggcgucacccuccugcugcccgagccggaguggaccuacccccggcucagcugucccggguccaccuuccagaaggcgcugcugaucagcccccaccgcuucggcgagacgaaggggaacuccgccccgcucaucauccgggagcccuuuaucgccugcggccccaacgagugcaagcacuucgcccugacccacuaugcggcccagcccggcggguacuacaacggcacccgcggggaccggaacaagcugcgccaucucaucagcgugaagcugggcaagaucccgaccguggagaacuccaucuuccacauggccgccuggagcggguccgccugucacgacggcaaggaguggacguacaucggcgucgacgggcccgacaauaacgcgcugcucaaggugaaguacggcgaggccuacaccgacaccuaccauagcuacgccuccaagauccugcggacccaggagucggccugcaacugcaucgggggcaauugcuaccugaugaucacggacggcagcgccuccggggugagcgagugucgcuuccucaagauccgggagggccgcaucaucaaggagaucuuccccaccgggcgggucaagcacaccgaggagugcacgugcggcuuugcguccaacaagaccaucgagugcgccugccgcgacaacaguuacaccgccaagcggcccuucgugaagcugaacguggagaccgacaccgccgagauccgccugaugugcacggauaccuaccucgacaccccgcggcccaacgacggguccaucaccggccccugcgagagcgauggcgacaagggguccggcgggaucaagggcggguucguccaccagcgcauggagagcaagaucggccggugguacucccgcacgaugaguaagaccgagcggaugggcauggggcuguacgugaaguacgacggcgaccccugggccgacuccgaugcgcuggccuucagcggggugauggucuccaugaaggagccgggcugguacagcuucggguuugagaucaaggacaagaagugcgacgugcccugcaucggcaucgagauggugcacgauggcgggaaggagaccuggcacuccgccgccaccgccaucuacugccucaugggcagcgggcagcugcugugggacacggucaccggcguggacauggcgcucuga

SEQ ID NO: 29671 - RNA, 1401 nt, Artificial Sequence; identical to SEQ ID NO: 29235
  derived and/or modified CDS sequence (AUadapt) from InfluenzaB__AGX21088__NA

SEQ ID NO: 29672 - RNA, 1401 nt, Artificial Sequence; identical to SEQ ID NO: 29235
  derived and/or modified CDS sequence (AUadapt) from InfluenzaB__AGX21099__NA

SEQ ID NO: 29673 - RNA, 1401 nt, Artificial Sequence
  derived and/or modified CDS sequence (AUadapt) from InfluenzaB__AGX21110__NA
augcugcccaguaccauccagacccucacgcuguuccugaccuccggcggggugcuccugagccuguacgucuccgcccuccugagcuaccugcucuacuccgauauccugcugaaguucagcccgaccgagaucaccgcccccacgaugucccucgacugcgcgaacgccagcaacgugcaggccgugaaucgcuucgccaccaagggcgucaccuuccugcugcccgagcccgaguggaccuacccgcggcucuccugccccgggagcacguuccagaaggcccugcugaucucgccccaucgcuucggcgagaccaaggggaacuccgcgccccucaucauccgggagccguucaucgccugcggccccaacgagugcaagcacuuugcccugacccacuacgccgcgcagcccggcggguacuacaacggcacccgcggggaccggaacaagcugcgccaucucaucuccgugaagcugggcaagauccccacgguggagaacagcaucuuccacauggccgccugguccgggagcgccugccacgauggcaaggaguggaccuacaucggcgucgacgggccggacaacgacgcccugcucaaggugaaguacggcgaggcguacaccgauaccuaccacuccuacgccaacaagauccugcggacgcaggagagcgccugcaacuguaucgggggcaacugcuaccugaugaucaccgacggcuccgccagcggggugagcgagugucgcuuccucaagauccgggagggccgcaucaucaaggagaucuuccccaccgggcgggucaagcacaccgaggagugcacgugcggcuucgccuccaacaagaccaucgagugugcgugccgcgacaacucguacaccgccaagcggcccuucgugaagcugaacguggagaccgauacggccgagauccgccugaugugcaccgacaccuaccucgacacgccccggccggacgacggguccaucaccggccccugcgagaguaacggcgacaagggguccggcgggaucaagggcggguucguccaccagcgcauggagagcaagaucggccggugguacucccgcaccaugagcaagaccgagcggaugggcauggggcuguaugugaaguacgacggcgaccccugggccgacuccgacgcccuggcguucagcggggugauggucuccaugaaggagcccggcugguauagcuucggguucgagaucaaggacaagaagugcgacgugccgugcaucggcaucgagauggugcaugacggcgggaaggagaccuggcacuccgccgccacggccaucuacugccucaugggcagcgggcagcugcugugggacaccgucaccggcguggacauggcccucuga

SEQ ID NO: 29674 - RNA, 1401 nt, Artificial Sequence
  derived and/or modified CDS sequence (AUadapt) from InfluenzaB__AGX21121__NA
augcugcccaguaccauccagacccucacgcuguuccugaccuccggcggggugcuccugagccuguacgucuccgcccuccugagcuaccugcucuauuccgacauccugcugaaguucagcccgaccgagaucaccgcccccacgaugucccucgacugcgcgaacgccaguaacgugcaggccgugaaccgcuccgccaccaagggcgucaccuuccugcugcccgagcccgaguggaccuacccgcggcucagcugccccggguccacguuucagaaggcccugcugaucucgccccaccgcuucggcgagaccaaggggaacuccgcgccccucaucauccgggagccguucaucgccugcggccccaaugagugcaagcacuucgcccugacccacuacgccgcgcagcccggcggguacuauaacggcacccgcggggaccggaacaagcugcgccaccucaucagcgugaagcugggcaagauccccacgguggagaacuccaucuuucacauggccgccuggagcggguccgccugccacgacggcaaggaguggaccuacaucggcgucgaugggccggacaacgacgcccugcucaaggugaaguacggcgaggcguacaccgacaccuaucacagcuacgccaacaagauccugcggacgcaggaguccgccugcaacuguaucgggggcaacugcuaccugaugaucaccgacggcagcgccagcgggguguccgagugucgcuuccucaagauccgggagggccgcaucaccaaggagaucuuccccaccgggcgggucaagcacacggaggagugcacgugcggcuucgccaguaacaagaccaucgagugcgcgugccgcgacaacuccuacaccgccaagcggcccuuugugaagcugaacguggagaccgacaccgccgagauccgccugaugugcaccgacaccuaccucgacacgccccggccggaugacgggagcaucaccggccccugcgaguccaacggcgacaaggggagcggcgggaucaagggcggguuuguccaccagcgcauggaguccaagaucggccggugguacagccgcaccauguccaagaccgagcggaugggcauggggcuguacgugaaguacgacggcgaucccugggccgacagcgacgcccuggcguucuccggggugauggucagcaugaaggagcccggcugguacuccuuuggguucgagaucaaggacaagaagugcgacgugccgugcaucggcaucgagauggugcacgauggcgggaaggagacguggcacagcgccgccaccgccaucuacugccucaugggcuccgggcagcugcugugggacaccgucaccggcguggacauggcccucuga

SEQ ID NO: 29675 - RNA, 1401 nt, Artificial Sequence; identical to SEQ ID NO: 29232
  derived and/or modified CDS sequence (AUadapt) from InfluenzaB__AGX21132__NA

SEQ ID NO: 29676 - RNA, 1401 nt, Artificial Sequence; identical to SEQ ID NO: 28662
  derived and/or modified CDS sequence (AUadapt) from InfluenzaB__AGX21143__NA

SEQ ID NO: 29677 - RNA, 1401 nt, Artificial Sequence; identical to SEQ ID NO: 29069
  derived and/or modified CDS sequence (AUadapt) from InfluenzaB__AGX21154__NA

SEQ ID NO: 29678 - RNA, 1401 nt, Artificial Sequence
  derived and/or modified CDS sequence (AUadapt) from InfluenzaB__AGX21165__NA
augcugcccaguaccauccagacccucacgcuguuccugaccuccggcggggugcuccugagccuguacgucuccgcccuccugagcuaccugcucuacuccgauauccugcugaaguucagcccgaccgagaucaccgcccccacgaugucccucgacugcgcgaacgccucgaacgugcaggccgugaaucgcuccgccaccaagggcgucaccuuccugcugcccgagcccgaguggaccuacccgcggcucagcugccccggguccacguuccagaaggcccugcugaucagcccccaccgcuuuggcgagaccaaggggaacuccgcgccccucaucauccgggagccguucaucgccugcggccccaacgagugcaagcacuucgcccugacccauuacgccgcgcagcccggcggguacuacaacggcacccgcggggaccggaacaagcugcgccaccucaucagugugaagcugggcaagauccccacgguggagaacuccaucuuccacauggccgccuggagcggguccgccugccacgauggcaaggaguggaccuacaucggcgucgacgggccggacaacgacgcccugcucaaggugaaguacggcgaggcguacaccgauaccuaccacucguacgccaacaagauccugcggacgcaggaguccgccugcaacuguaucgggggcaacugcuaccugaugaucaccgacggcagcgccagcgggguguccgagugccgcuuucucaagauccgggagggccgcaucaucaaggagaucuuccccaccgggcgggucaagcacaccgaggagugcacgugcggcuucgccagcaacaagaccaucgagugugcgugccgcgacaacuccuacaccgccaagcggcccuucgugaagcugaacauggagaccgauacggccgagauccgccugaugugcaccgacaccuaccucgacacgccccggccggacgacgggagcaucaccggccccugugaguccaacggcgacaaggggucgggcgggaucaagggcggguucgugcaccagcgcauggaguccaagaucggccggugguacagccgcaccauguccaagaccgagcggaugggcauggggcuguaugucaaguacgacggcgaccccugggccgacagcgacgcccuggcguucuccggggugauggugaguaugaaggagcccggcugguacuccuucggguucgagaucaaggacaagaagugcgacgucccgugcaucggcaucgagauggugcaugacggcgggaaggagaccuggcacagcgccgccacggccaucuacugccucaugggcuccgggcagcugcugugggacaccgugaccggcgucgacauggcccucuga

SEQ ID NO: 29679 - RNA, 1401 nt, Artificial Sequence; identical to SEQ ID NO: 29069
  derived and/or modified CDS sequence (AUadapt) from InfluenzaB__AGX21176__NA

SEQ ID NO: 29680 - RNA, 1401 nt, Artificial Sequence
  derived and/or modified CDS sequence (AUadapt) from InfluenzaB__AGX21187__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccucgaaugugcaggccgugaaccgcuccgccaccaagggcgucacccuccugcugcccgagccggaguggaccuacccccggcucagcugccccggguccacguuccagaaggcccugcugaucagcccccaucgcuucggcgagaccaaggggaacuccgcgccgcucaucauccgggagcccuucaucgccugcggccccaacgagugcaagcacuuugcccugacccacuacgccgcgcagcccggcggguacuacaacggcacccgcggggaccggaauaagcugcgccaccucaucagcgugaagcugggcaagaucccgacgguggagaacuccaucuuccacauggccgccuggagcggguccgccugucacgacggcaaggaguggaccuacaucggcgucgacgggcccgacaacaacgcccugcucaaggugaaguauggcgaggcguacaccgacaccuaccacucguacgccaauaagauccugcggacgcaggaguccgccugcaacugcaucgggggcaacugcuaccugaugaucaccgauggcagcgccagcgggguguccgagugccgcuuccucaagauccgggagggccgcaucaucaaggagaucuuccccaccgggcgggucaagcacaccgaggaguguacgugcggcuucgccagcaacaagaccaucgagugcgugugccgcgacaauuccuacaccgcgaagcggcccuucgugaagcugaacgucgagaccgacacggccgaggugcgccugaugugcaccgacaccuaucucgacaccccgcggcccaacgacgggagcaucacgggccccugcgaguccgacggcgauaaggggucgggcgggaucaagggcggguucgugcaccagcgcauggaguccaagaucggccggugguacagccgcaccauguccaagaccgagcggaugggcauggggcuguacgucaaguacgauggcgaccccugggccgacagcgacgcccugaccuucuccggggugauggugagcaugaaggagccgggcugguauuccuucggguucgagaucaaggacaagaagugcgacguccccugcaucggcaucgagauggugcaugacggcgggaaggagacguggcacagcgccgcgaccgccaucuacugccucaugggcuccgggcagcugcugugggacaccgugaccggcgucgacauggcccucuga

SEQ ID NO: 29681 - RNA, 1401 nt, Artificial Sequence
  derived and/or modified CDS sequence (AUadapt) from InfluenzaB__AGX21198__NA
augcugcccaguaccauccagaugcucacccuguuccugacguccggcggggugcuccugagccuguacgucuccgccucgcucuccuaccugcuguacagcgauauccuccugaaguucuccccgaccgagaucaccgcccccaccaugccccuggacugcgcgaacgccagcaacgugcacgccgugaaucgcuccgccacgaagggcgucaccuuccuccugcccgagccggaguggaccuacccccggcugucgugccccggguccaccuuccagaaggcccuccugaucagcccccaccgcuucggcgagacgaaggggaauuccgcgccgcugaucauccgggagcccuucaucgccugcgagcccaacgagugcaagcacuucgcccucacccacuaugccgcgcagcccggcggcuacuacaacgggacccgcggcgaccggaacaagcugcgccaccugaucagcgugaagcucgggaagaucccgaccguggagaacuccaucuuucacauggccgccuggucgggcuccgccugccacgacgggaaggaguggacguacaucggcgucgacggccccgauaacaacgcccugcugaagaucaaguacggggaggcguacaccgacaccuaccacagcuaugccaacaacauccuccggacccaggaguccgccugcaacugcaucggcgggaacugcuaucugaugaucacggacggcucggccagcggcguguccgagugccgcuuccugaagauccgggaggggcgcaucaucaaggagaucuuccccaccggccgggugaagcacaccgaggagugcacguguggguucgccagcaacaagaccaucgagugcgcgugccgcgacaacuccuauaccgccaagcggcccuucgucaagcucaacguggagaccgacaccgccgagauccgccugaugugcacggacaccuaccuggacaccccgcggcccgacgauggcucgaucaccgggcccugcgaguccaacggcgacaagggcagcgggggcaucaagggcggguucgugcaccagcgcauggccuccaagaucgggcggugguauagccgcacgauguccaagaccgagcggaagggcaugggccucuacgucaaguacgacggggaccccuggaccgacucggacgcccuggcguuucgcggcgugaugguguccaugaaggagccggggugguacagcuucggcuucgagaucaaggacaagaagugcgacguccccuguaucgggaucgagauggugcacgacggcggcaaggagaccuggcacuccgccgccacggccaucuacugccugauggggagcggccagcuccugugggacaccgugaccggggucgacauggcccuguga

SEQ ID NO: 29682 - RNA, 1401 nt, Artificial Sequence; identical to SEQ ID NO: 29069
  derived and/or modified CDS sequence (AUadapt) from InfluenzaB__AGX21209__NA

SEQ ID NO: 29683 - RNA, 1401 nt, Artificial Sequence; identical to SEQ ID NO: 29232
  derived and/or modified CDS sequence (AUadapt) from InfluenzaB__AGX21220__NA

SEQ ID NO: 29684 - RNA, 1401 nt, Artificial Sequence
  derived and/or modified CDS sequence (AUadapt) from InfluenzaB__AGX21231__NA
augcugcccaguaccauccagacccucacgcuguuccugaccuccggcggggugcuccugagccuguacgucuccgcccuccugagcuaccugcucuacuccgauauccugcugaaguucagcccgaccgagaucaccgcccccacgaugucccucgacugcgcgaacgccagcaacgugcaggccgugaaucgcuccgccaccaagggcgucaccuuccugcugcccgagucggaguggaccuacccccggcucuccugcccggggagcacguuccagaaggcccugcugaucagcccccaucgcuucggcgagaccaaggggaacuccgcgccccucaucauccgggagcccuucaucgccugcggcccgaacgagugcaagcacuuugcccugacccacuacgccgcgcagcccggcggguacuacaacggcacccgcggggaccggaacaagcugcgccaucucaucuccgugaagcugggcaagauccccacgguggagaacagcaucuuccacauggccgccugguccgggagcgccugccacgauggcaaggaguggaccuacaucggcgucgacgggcccgacaacgacgcccugcucaaggugaaguacggcgaggcguacaccgauaccuaccacuccuacgccaacaagauccugcggacgcaggagucggccugcaacuguaucgggggcaacugcuaccugaugaucaccgacggcagcgccuccggggugagcgagugucgcuuccucaagauccgggagggccgcaucaucaaggagaucuucccgaccgggcgggucaagcacaccgaggagugcacgugcggcuucgccuccaacaagaccaucgagugugcgugccgcgacaacagcuacaccgccaagcggcccuucgugaagcugaacguggagaccgauacggccgagauccgccugaugugcaccgacaccuaccucgacacgccccggcccgacgacggguccaucaccggcccgugcgagaguaacggcgacaagggguccggcgggaucaagggcggguucguccaccagcgcauggagucgaagaucggccggugguacucccgcaccaugagcaagaccgagcggaugggcauggggcuguaugugaaguacgacggcgaccccugggccgacuccgacgcccuggcguucagcggggugauggucuccaugaaggagcccggcugguauagcuucggguucgagaucaaggacaagaagugcgacgugcccugcaucggcaucgagauggugcaugacggcgggaaggagaccuggcacuccgccgccacggccaucuacugccucaugggcagcgggcagcugcugugggacaccgucaccggcguggacauggcccucuga

SEQ ID NO: 29685 - RNA, 1401 nt, Artificial Sequence; identical to SEQ ID NO: 29235
  derived and/or modified CDS sequence (AUadapt) from InfluenzaB__AGX21242__NA

SEQ ID NO: 29686 - RNA, 1401 nt, Artificial Sequence; identical to SEQ ID NO: 29069
  derived and/or modified CDS sequence (AUadapt) from InfluenzaB__AGX21253__NA

SEQ ID NO: 29687 - RNA, 1401 nt, Artificial Sequence
  derived and/or modified CDS sequence (AUadapt) from InfluenzaB__AGX21264__NA
augcugcccaguaccauccagacccucacgcuguuccugaccuccggcggggugcuccugagccuguacgucuccgccucgcucuccuaccugcuguacagcgauauccuccugaaguucuccaccaccgagaucacggccccgaccaugccccuggacugcgcgaacgccagcaacgugcaggccgugaaccgcuccgccaccaagggcgucacccuccugcugcccgagcccgaguggacguauccgcggcucucgugccccggguccaccuuccagaaggcccugcugaucagcccccaccgcuucggcgagaacaaggggaacuccgcgccccucaucauccgggagccguuuaucgccugcggccccaacgagugcaagcacuucgcccugacccacuacgccgcgcagcccggcggguauuacaacggcacccgcggggaccggaacaagcugcgccaccucaucagcgugaagcugggcaagauccccacgguggagaacuccaucuuccauauggccgccuggucgggguccgccugccacgacggcaaggaguggaccuacaucggcgucgacgggccggacaauaacgcccugcucaaggugaaguacggcgaggcguacaccgacaccuaccacagcuaugccaacaagauccugcggacgcaggaguccgccugcaacugcaucgggggcaacugcuaccugaugaucaccgacggcagugccucggggguguccgagugccgcuuccucaagauccgggagggccgcaucaucaaggagaucuuccccaccgggcgggucaagcacaccgaggagugcacgugcggcuuugccagcaacaagaccaucgagugcgcgugccgcgacaacuccuacaccgccaagcggcccuucgugaagcugaauguggagaccgacacggccgagauccgccugaugugcaccgacaccuaccucgacacgccccggccgaacgacgggaguaucaccggccccugcgaguccgacggcgacaaggggucgggcgggaucaagggcggguucguccaccagcgcauggaguccaagaucggccggugguacagucgcaccauguccaagaccgagcggaugggcauggggcuguacgugaaguacgacggcgaccccugggccgacagcgacgcccuggcguucuccggggugauggucaguaugaaggagcccuccugguacagcuucggcuucgagaucaaggacaagaagugcgacgugccguguaucgggaucgagauggugcacgacggcggcaaggagaccuggcacuccgccgccacggccaucuacugccucauggggagcggccagcugcugugggacaccgucaccgggguggacauggcccucuga

SEQ ID NO: 29688 - RNA, 1401 nt, Artificial Sequence; identical to SEQ ID NO: 28662
  derived and/or modified CDS sequence (AUadapt) from InfluenzaB__AGX21275__NA

SEQ ID NO: 29689 - RNA, 1401 nt, Artificial Sequence; identical to SEQ ID NO: 29069
  derived and/or modified CDS sequence (AUadapt) from InfluenzaB__AGX21286__NA

SEQ ID NO: 29690 - RNA, 1401 nt, Artificial Sequence
  derived and/or modified CDS sequence (AUadapt) from InfluenzaB__AGX21297__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggacuggaccuacccccggcucagcugccccggguccacguuucagaaggcccugcugaucagcccccaccgcuucggcgagaccaaggggaacuccgcgccgcucaucauccgggagcccuucaucgccugcggccccaaugagugcaagcacuucgcccugacccacuacgccgcgcagcccggcggguacuauaacggcacccgcggggaccggaacaagcugcgccaccucaucagcgugaagcugggcaagaucccgacgguggagaacuccaucuuucacauggccgccuggagcggguccgccugccacgacggcaaggaguggaccuacaucggcgucgaugggcccgacaacaacgcccugcucaaggugaaguacggcgaggcguacaccgacaccuaucacucguacgccaacaagauccugcggacgcaggaguccgccugcaacuguaucgggggcaacugcuaccugaugaucaccgacggcagcgccagcgggguguccgagugucgcuuccucaagauccgggagggccgcaucaucaaggagaucuuccccaccgggcgggucaagcacaccgaggagugcacgugcggcuucgccaguaacaagaccaucgagugcgcgugccgcgacaacuccuacaccgccaagcggcccuuugugaagcugaacguggagaccgacacggccgagguccgccugaugugcaccgacaccuaccucgacaccccgcggcccaaugacgggagcaucacgggccccugcgaguccgacggcgacaaggggucgggcgggaucaagggcggguuugugcaccagcgcauggaguccaagaucggccggugguacagccgcaccauguccaagaccgagcggaugggcauggggcuguacgugaaguacgacggcgaucccugggccgacagcgacgcccugaccuucuccggggucauggugagcaugaaggagccgggcugguacuccuuuggguucgagaucaaggacaagaagugcgacgugcccugcaucggcaucgagaugguccacgauggcgggaaggagacguggcacagcgcggccaccgccaucuacugccucaugggcuccgggcagcugcugugggacaccgugaccggcguggacauggcccucuga

SEQ ID NO: 29691 - RNA, 1401 nt, Artificial Sequence
  derived and/or modified CDS sequence (AUadapt) from InfluenzaB__AGX21308__NA
augcugcccaguaccauccagaugcucacccuguuccugacguccggcggggugcuccugagccuguacgucuccgccagccucuccuaccugcuguacagugacauccuccugaaguucuccccgaccgagaucaccgcccccaccaugccccuggacugcgcgaacgccagcaaugugcacgccgugaaccgcuccgccacgaagggcgucaccuuccuccugcccgagccggaguggaccuacccccggcugagcugccccggguccaccuuccagaaggcccuccugaucaguccccaccgcuucggcgagacgaaggggaacuccgcgccgcugaucauccgggagcccuucaucgccugcggccccaacgaguguaagcacuucgcccucacccacuacgccgcgcagcccggcggguacuacaacggcacccgcggggaucggaacaagcugcgccaccugaucagcgugaagcucggcaagaucccgaccguggagaacuccaucuuccacauggccgccuggaguggguccgccugccacgacggcaaggaguggacguacaucggcgucgacgggcccgacaauaacgcccugcugaagaucaaguacggcgaggcguacaccgacaccuaccacucguaugccaacaacauccuccggacccaggaguccgccugcaacugcaucgggggcaacuguuaccugaugaucacggacggcagcgccagcgggguguccgagugccgcuuccugaagauccgggagggccgcaucaucaaggagaucuuccccaccgggcgggugaagcauaccgaggagugcacgugcggcuucgccucgaacaagaccaucgagugcgcgugucgcgacaacuccuacaccgccaagcggcccuucgucaagcucaacguggagaccgacaccgccgagauccgccugauguguacggacaccuaccuggacaccccgcggcccgacgacgggagcaucaccggccccugcgaguccaauggcgacaaggggagcggcgggaucaagggcggguucgugcaccagcgcauggccuccaagaucggccggugguacucgcgcacgauguccaagaccgagcggaagggcauggggcucuaugucaaguacgacggcgaccccuggaccgacagcgacgcccuggcgcugcgcggggugaugguguccaugaaggagccgggcugguacaguuucggguucgagaucaaggacaagaagugcgacguccccugcaucggcaucgagauggugcaugacggcgggaaggagaccuggcacuccgccgccacggccaucuacugccucaugggcagcgggcagcugcugugggacaccgugaccggcgucgacauggcccucuga

SEQ ID NO: 29692 - RNA, 1401 nt, Artificial Sequence; identical to SEQ ID NO: 29013
  derived and/or modified CDS sequence (AUadapt) from InfluenzaB__AGX21319__NA

SEQ ID NO: 29693 - RNA, 1401 nt, Artificial Sequence; identical to SEQ ID NO: 28662
  derived and/or modified CDS sequence (AUadapt) from InfluenzaB__AGX21330__NA

SEQ ID NO: 29694 - RNA, 1401 nt, Artificial Sequence; identical to SEQ ID NO: 28662
  derived and/or modified CDS sequence (AUadapt) from InfluenzaB__AGX21341__NA

SEQ ID NO: 29695 - RNA, 1401 nt, Artificial Sequence; identical to SEQ ID NO: 29235
  derived and/or modified CDS sequence (AUadapt) from InfluenzaB__AGX21352__NA

SEQ ID NO: 29696 - RNA, 1401 nt, Artificial Sequence
  derived and/or modified CDS sequence (AUadapt) from InfluenzaB__AGX21363__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucucgugccccggguccacguuccagaaggcccugcugaucaguucccaccgcuucggcgagaccaaggggaacagcgcgccccucaucauccgggagccguucguggccugcggccccaaugagugcaagcacuucgcccugacccacuacgccgcgcagcccggcggguacuauaacggcacccgcggggaccggaacaagcugcgccaccucaucuccgugaagcugggcaagauccccacggucgagaacagcaucuuucacauggccgccugguccgggagcgccugccacgacggcaaggaguggaccuacaucggcguggaugggccggacaacaacgcccugcucaaggugaaguacggcgaggcguacaccgacaccuaucacuccuacgccaacaagauccugcggacgcaggagucggccugcaacuguaucgggggcaacugcuaccugaugaucaccgacggcagcgccuccggggucagcgagugucgcuuccucaagauccgggagggccgcaucaucaaggagaucuuccccaccgggcgggugaagcacaccgaggagugcacgugcggcuucgccuccaauaagaccaucgagugcgcgugccgcgacaacagcuacaccgccaagcggcccuuugugaagcugaacgucgagaccgacacggccgagauccgccugaugugcaccgacaccuaccucgacacgccccggccgaaugacggguccaucaccggccccugcgagagcgacggcgacaagggguccggcgggaucaagggcggguucgugcaucagcgcauggagucgaagaucggccggugguacucccgcaccaugagcaagaccgagcggaugggcauggggcuguacgugaaguacgacggcgaucccugggccgacuccgacgcccuggcguucagcggggucaugguguccaugaaggagcccggcugguacagcuuuggguucgagaucaaggacaagaagugcgacgugccgugcaucggcaucgagaugguccacgauggcgggaaggagaccuggcacuccgccgccacggccaucuacugccucaugggcagcgggcagcugcugugggacaccgugaccggcguggacauggcccucuga

SEQ ID NO: 29697 - RNA, 1401 nt, Artificial Sequence; identical to SEQ ID NO: 28662
  derived and/or modified CDS sequence (AUadapt) from InfluenzaB__AGX21374__NA

SEQ ID NO: 29698 - RNA, 1401 nt, Artificial Sequence; identical to SEQ ID NO: 29069
  derived and/or modified CDS sequence (AUadapt) from InfluenzaB__AGX21385__NA

SEQ ID NO: 29699 - RNA, 1401 nt, Artificial Sequence; identical to SEQ ID NO: 29069
  derived and/or modified CDS sequence (AUadapt) from InfluenzaB__AGX21396__NA

SEQ ID NO: 29700 - RNA, 1401 nt, Artificial Sequence; identical to SEQ ID NO: 28662
  derived and/or modified CDS sequence (AUadapt) from InfluenzaB__AGX21407__NA

SEQ ID NO: 29701 - RNA, 1401 nt, Artificial Sequence; identical to SEQ ID NO: 28662
  derived and/or modified CDS sequence (AUadapt) from InfluenzaB__AGX21418__NA

SEQ ID NO: 29702 - RNA, 1401 nt, Artificial Sequence
  derived and/or modified CDS sequence (AUadapt) from InfluenzaB__AGX21429__NA
augcugcccaguaccauccagacccucacgcuguuccugaccuccggcggggugcuccugagccuguacgucuccgcccuccugagcuaccugcuccacuccgauauccugcugaaguucagcccgaccgagaucaccgcccccacgaugucccucgacugcgcgaacgccagcaaugugcaggccgugaaccgcuccgucaccaagggcgugaccuuccugcugcccgagcccgaguggaccuacccgcggcucagcugccccggguccacguuccagaaggcccugcugaucucgccccaucgcuucggcgagaccaaggggaacuccgcgccccucaucauccgggagccguucaucgccugcggccccaacgagugcaagcauuucgcccugacccacuacgccgcccagcccggcggguacuacaacggcacccgcggggaucggaacaagcugcgccaccucaucagcgugaagcugggcaagauccccacggucgagaacuccaucuuccacauggcggccuggagcggguccgccugucacgacggcaaggaguggaccuacaucggcguggacgggccggacaacgaugcccugcucaaggugaaguacggcgaggccuacaccgacaccuaccacagcuaugcgaacaagauccugcggacgcaggaguccgccugcaacugcaucgggggcaacugcuaccugaugaucaccgauggcagcgccagcggggucuccgagugccgcuuccucaagauccgggagggccgcaucaucaaggagaucuuccccaccgggcgggugaagcacaccgaggaguguacgugcggcuucgccucgaacaagaccaucgagugcgccugccgcgauaacuccuacaccgcgaagcggcccuucgugaagcugaacgucgagaccgacacggccgagauccgccugaugugcaccgacaccuaucucgacacgccccggccggacgacgggagcaucaccggccccugcgaguccaacggcgauaaggggagcggcgggaucaagggcggguucgugcaccagcgcauggaguccaagaucggccggugguacagccgcaccauguccaagaccgagcggaugggcauggggcuguacgugaaguaugacggcgaccccugggccgacagcgacgcccuggccuucuccggggucauggugagcaugaaggagcccggcugguauuccuucggguucgagaucaaggacaagaagugcgacgugccgugcaucggcaucgagaugguccaugacggcgggaaggagaccuggcacagcgcggccacggccaucuacugccucaugggcuccgggcagcugcugugggacaccgugaccggcguggacauggcccucuga

SEQ ID NO: 29703 - RNA, 1401 nt, Artificial Sequence; identical to SEQ ID NO: 29069
  derived and/or modified CDS sequence (AUadapt) from InfluenzaB__AGX21440__NA

SEQ ID NO: 29704 - RNA, 1401 nt, Artificial Sequence; identical to SEQ ID NO: 29069
  derived and/or modified CDS sequence (AUadapt) from InfluenzaB__AGX21451__NA

SEQ ID NO: 29705 - RNA, 1401 nt, Artificial Sequence; identical to SEQ ID NO: 29653
  derived and/or modified CDS sequence (AUadapt) from InfluenzaB__AGX21462__NA

SEQ ID NO: 29706 - RNA, 1401 nt, Artificial Sequence
  derived and/or modified CDS sequence (AUadapt) from InfluenzaB__AGX21473__NA
augcugcccaguaccauccagacccucacgcuguuccugaccuccggcggggugcuccugagccuguacgucuccgcccuccugagcuaccugcucuauuccgacauccugcugaaguucagcccgaccgagaucaccgcccccacgaugucccucgacugcgcgaaugccagcaacgugcaggccgugaaccgcuccgccaccaagggcgucaccuuccugcugcccgagcccgaguggaccuacccgcggcucaguugccccggguccacguuccagcgcgcccugcugaucagcccccaccgguucggcgaggcgaaggggaauuccgcgccccucaucauccgcgagccguucaucgccugcggccccaacgagugcaagcacuucgcccugacccauuacgccgcccagcccggcggguacuacaacggcacccgcggggaccggaauaagcugcggcaccucaucagcgugaagcugggcaagauccccaccguggagaacuccaucuuccacauggccgccuggaguggguccgccugccacgacggcaaggaguggacguacaucggcgucgacgggccggauaacgacgcgcugcucaaggugaaguacggcgaggccuacaccgacaccuaucacagcuacgccaacaagauccugcgcacccaggaguccgccugcaacuguaucgggggcaacugcuaccugaugaucacggacggcagcgccagugggguguccgagugccgguuccucaagauccgcgagggccggaucaucaaggagauccugcccaccgggcgcgucaagcacaccgaggagugcacgugcggcuuugcgagcaacaagaccaucgagugcgccugccgggacaauuccuacaccgccaagcgccccuucgugaagcugaacguggagaccgacaccgccgagauccggcucaugugcacggauaccuaccuggacacgccccgcccggacgacgggagcaucaccggccccugcgaguccaauggcgacaaggggagcggcgggaucaagggcggguucguccaccagcggauggaguccaagaucggccgcugguacagucggaccauguccaagaccgagcgcaugggcauggggcuguacgugaaguacgacggcgaccccugggccgacagugacgcgcucguguucuccggggucauggugagcaugaaggagcccggcugguacuccuucggguuugagaucaaggacaagaagugcgacgugccgugcaucggcaucgagaugguccacgauggcgggaaggagaccuggcacagcgccgccaccgccaucuacugccugaugggcuccgggcagcugcucugggacacggugaccggcguggacauggcccuguga

SEQ ID NO: 29707 - RNA, 1401 nt, Artificial Sequence; identical to SEQ ID NO: 29013
  derived and/or modified CDS sequence (AUadapt) from InfluenzaB__AGX21484__NA

SEQ ID NO: 29708 - RNA, 1401 nt, Artificial Sequence; identical to SEQ ID NO: 29069
  derived and/or modified CDS sequence (AUadapt) from InfluenzaB__AGX21495__NA

SEQ ID NO: 29709 - RNA, 1401 nt, Artificial Sequence; identical to SEQ ID NO: 29069
  derived and/or modified CDS sequence (AUadapt) from InfluenzaB__AGX21506__NA

SEQ ID NO: 29710 - RNA, 1401 nt, Artificial Sequence
  derived and/or modified CDS sequence (AUadapt) from InfluenzaB__AGX21517__NA
augcugcccaguaccauccagacccucacgcuguuccugaccuccggcggggugcuccugagccuguacgucuccgcccuccugagcuaccugcucuacuccaauauccugcugaaguucagcccgaccgagaucaccgcccccacgaugucccucgacugcgcgaacgccucgaacgugcaggccgugaaucgcuccgccaccaagggcgucaccuuccugcugcccgagcccgaguggaccuacccgcggcucagcugccccggguccacguuccagaaggcccugcugaucagcccccaccgcuuuggcgagaccaaggggaacuccgcgccccucaucauccgggagccguucaucgccugcggccccaacgagugcaagcacuucgcccugacccauuacgccgcgcagcccggcggguacuacaacggcacccgcggggaccggaacaagcugcgccaccucaucagugugaagcugggcaagauccccacgguggagaacuccaucuuccacauggccgccuggagcggguccgccugccacgauggcaaggaguggaccuacaucggcgucgacgggccggacaacgacgcccugcucaaggugaaguacggcgaggcguacaccgauaccuaccacucguacgccaacaagauccugcggacgcaggaguccgccugcaacuguaucgggggcaacugcuaccugaugaucaccgacggcagcgccagcgggguguccgagugccgcuuucucaagauccgggagggccgcaucaucaaggagaucuuccccaccgggcgggucaagcacaccgaggagugcacgugcggcuucgccagcaacaagaccaucgagugugcgugccgcgacaacuccuacaccgccaagcggcccuucgugaagcugaacguggagaccgauacggccgagauccgccugaugugcaccgacaccuaccucgacacgccccggccggacgacgggagcaucaccggccccugugaguccaacggcgacaaggggucgggcgggaucaagggcggguucguccaccagcgcauggaguccaagaucggccggugguacagccgcaccauguccaagaccgagcggaugggcauggggcuguaugugaaguacgacggcgaccccugggccgacagcgacgcccuggcguucuccggggugauggucaguaugaaggagcccggcugguacuccuucggguucgagaucaaggacaagaagugcgacgugccgugcaucggcaucgagauggugcaugacggcgggaaggagaccuggcacagcgccgccacggccaucuacugccucaugggcuccgggcagcugcugugggacaccgucaccggcguggacauggcccucuga

SEQ ID NO: 29711 - RNA, 1401 nt, Artificial Sequence
  derived and/or modified CDS sequence (AUadapt) from InfluenzaB__AGX21528__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccucgaaugugcaggccgugaaccgcuccgccaccaagggcgucacccuccugcugcccgagccggaguggaccuacccccggcucagcugccccggguccacguuccagaaggcccugcugaucagcccccaccgcuuuggcgagaccaaggggaacuccgcgccgcucaucauccgggagcccuucaucgccugcggccccaacgagugcaagcacuuugcccugacccacuacgccgcgcagcccggcggguacuacaacggcacccgcggggaccggaauaagcugcgccaccucaucagcgugaagcugggcaagaucccgacgguggagaacuccaucuuccacauggccgccuggucgggguccgccugccaugacggcaaggaguggaccuacaucggcgucgacgggcccgacaacaacgcccugcucaaggugaaguauggcgaggcguacaccgacaccuaccacagcuacgccaauaagauccugcggacgcaggaguccgccugcaacugcaucgggggcaacugcuaccugaugaucaccgacggcagugccagcgggguguccgagugccgcuuccucaagauccgggagggccgcaucaucaaggagaucuuccccaccgggcgggucaagcacaccgaggagugcacguguggcuucgccucgaacaagaccaucgagugcgcgugccgcgacaauuccuacaccgccaagcggcccuucgugaagcugaacguggagaccgacacggccgagguccgccugaugugcaccgacaccuaccucgauaccccgcggcccaacgacgggagcaucacgggccccugcgaguccgacggcgacaaggggaguggcgggaucaagggcggguucgugcaccagcgcauggaguccaagaucggccggugguacagccgcaccauguccaagaccgagcggaugggcauggggcuguacgugaaguacgauggcgaccccugggccgacucggacgcccugaccuucuccggggucauggugagcaugaaggagccgggcugguacuccuuuggguucgagaucaaggacaagaagugcgacgugcccugcaucggcaucgagaugguccacgauagcggcaaggagacguggcacuccgcggccaccgccaucuacugccucauggggagcggccagcugcugugggacaccgugaccgggguggacauggcccucuga

SEQ ID NO: 29712 - RNA, 1401 nt, Artificial Sequence; identical to SEQ ID NO: 29069
  derived and/or modified CDS sequence (AUadapt) from InfluenzaB__AGX21539__NA

SEQ ID NO: 29713 - RNA, 1401 nt, Artificial Sequence
  derived and/or modified CDS sequence (AUadapt) from InfluenzaB__AGX21550__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuucagaaggcccugcugaucucgccccaccgcuucggcgagaccaaggggaacuccgcgccgcucaucauccgggagcccuucaucgccugcggccccaaugagugcaagcacuucgcccugacccacuacgccgcgcagcccggcggguauuacaacggcacccgcggggaccggaacaagcugcgccaccucaucagcgugaagcugggcaagaucccgacgguggagaauuccaucuuccacauggccgccuggagcggguccgccugccacgauggcaaggaguggaccuacaucggcgucgacgggcccgacaacaacgcccugcucaaggugaaguacggcgaggcguauaccgacaccuaccacagcuacgccaauaagauccugcggacgcaggaguccgccugcaacugcaucgggggcaacugcuaccugaugaucaccgauggcagcgccagcgggguguccgagugccgcuuccucaagauccgggagggccgcaucaucaaggagaucuuccccgccgggcgggucaagcauaccgaggagugcacgugcggcuucgcgucgaacaagaccaucgagugcgccugucgcgacaacuccuacaccgccaagcggcccuucgugaagcugaacguggagaccgauaccgccgagguccgccugaugugcacggacaccuaccucgacaccccgcggcccaacgacgggaguaucaccggccccugcgaguccgacggcgacaaggggagcggcgggaucaagggcggguucgugcaucagcgcauggaguccaagaucggccggugguacagccgcacgauguccaagaccgagcggaugggcauggggcuguacgugaaguacgacggcgaccccugggccgauagcgacgcgcugaccuucuccggggucauggugagcaugaaggagccgggcugguacuccuuuggguucgagaucaaggacaagaagugcgacgugcccugcaucggcaucgagaugguccacgauggcgggaaggagaccuggcacagcgccgccacggccaucuacugccucaugggcuccgggcagcugcugugggacaccgugaccggcguggacauggcccucuga

SEQ ID NO: 29714 - RNA, 1401 nt, Artificial Sequence
  derived and/or modified CDS sequence (AUadapt) from InfluenzaB__AGX21561__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuucagaaggcccugcugaucucgccccaccgcuucggcgagaccaaggggaacuccgcgccgcucaucauccgggagcccuucaucgccugcggccccaaugagugcaagcacuucgcccugacccacuacgccgcgcagcccggcggguauuacaacggcacccgcggggaccggaacaagcugcgccaccucaucagcgugaagcugggcaagaucccgacgguggagaauuccaucuuccacauggccgccuggagcggguccgccugccacgauggcaaggaguggaccuacaucggcgucgacgggcccgacaacaacgcccugcucaaggugaaguacggcgaggcguauaccgacaccuaccacagcuacgccaauaagauccugcggacgcaggaguccgccugcaacugcaucgggggcaacugcuaccugaugaucaccgauggcagcgccagcgggguguccgagugccgcuuccucaagguccgggagggccgcaucaucaaggagaucuuccccaccgggcgggugaagcauaccgaggagugcacgugcggcuucgccucgaacaagaccaucgagugcgcgugucgcgacaacuccuacaccgccaagcggcccuucgugaagcugaacgucgagaccgauacggccgaggugcgccugaugugcaccgacaccuaccucgacaccccgcggcccaacgacgggaguaucacgggccccugcgaguccgacggcgacaaggggagcggcgggaucaagggcggguucgugcaucagcgcauggaguccaagaucggccggugguacagccgcaccauguccaagaccgagcggaugggcauggggcuguacgucaaguacgacggcgaccccugggccgauagcgacgcccugaccuucuccggggugauggugagcaugaaggagccgggcugguacuccuuuggguucgagaucaaggacaagaagugcgacguccccugcaucggcaucgagauggugcacgauggcgggaaggagacguggcacagcgcggccaccgccaucuacugccucaugggcuccgggcagcugcugugggacaccgugaccggcgucgacauggcccucuga

SEQ ID NO: 29715 - RNA, 1401 nt, Artificial Sequence; identical to SEQ ID NO: 29013
  derived and/or modified CDS sequence (AUadapt) from InfluenzaB__AGX21572__NA

SEQ ID NO: 29716 - RNA, 1401 nt, Artificial Sequence
  derived and/or modified CDS sequence (AUadapt) from InfluenzaB__AGX21583__NA
augcugcccaguaccauccagacccucacgcuguuccugaccuccggcggggugcuccugagccuguacgucuccgcccuccugagcuaccugcucuauuccgacauccugcugaaguucagcccgaccgagaucaccgcccccacgaugucccucgacugcgcgaaugccagcaacgugcaggccgugaaccgcuccgccaccaagggcgucaccuuccugcugcccgagcccgaguggaccuacccgcggcucaguugccccggguccacguuccagcgcgcccugcugaucagcccccaccgguucggcgaggcgaaggggaauuccgcgccccucaucauccgcgagccguucaucgccugcggccccaacgagugcaagcacuucgcccugacccauuacgccgcccagcccggcggguacuacaacggcacccgcggggaccggaauaagcugcggcaccucaucagcgugaagcugggcaagauccccaccguggagaacuccaucuuccacauggccgccuggaguggguccgccugccacgacggcaaggaguggacguacaucggcgucgacgggccggauaacgacgcgcugcucaaggugaaguacggcgaggccuacaccgacaccuaucacagcuacgccaacaagauccugcgcacccaggaguccgccugcaacuguaucgggggcaacugcuaccugaugaucacggacggcagcgccagugggguguccgagugccgguuccucaagauccgcgagggccggaucaucaaggagauccugcccaccgggcgcgucaagcacaccgaggagugcacgugcggcuuugcgagcaacaagaccaucgagugcgccugccgggacaauuccuacaccgccaagcgccccuucgugaagcugaacguggagaccgacaccgccgagauccggcucaugugcacggauaccuaccuggacacgccccgcccggacgacgggagcaucaccggccccugcgaguccaauggcgacaaggggagcggcgggaucaagggcggguucguccaccagcggauggaguccaagaucggccgcugguacagucggaccauguccaagaccgagcgcaugggcauggagcuguacgugaaguacgacggggaccccugggccgacagugacgcgcucgccuucuccggcgugauggucagcaugaaggagcccgggugguacuccuucggcuuugagaucaaggacaagaagugcgacgugccgugcaucgggaucgagauggugcacgauggcggcaaggagaccuggcacagcgccgccaccgccaucuacugccugaugggguccggccagcugcucugggacacggucaccgggguggacauggcgcuguga

SEQ ID NO: 29717 - RNA, 1401 nt, Artificial Sequence; identical to SEQ ID NO: 29013
  derived and/or modified CDS sequence (AUadapt) from InfluenzaB__AGX21594__NA

SEQ ID NO: 29718 - RNA, 1401 nt, Artificial Sequence; identical to SEQ ID NO: 29235
  derived and/or modified CDS sequence (AUadapt) from InfluenzaB__AGX21605__NA

SEQ ID NO: 29719 - RNA, 1401 nt, Artificial Sequence
  derived and/or modified CDS sequence (AUadapt) from InfluenzaB__AGX21615__NA
augcugcccaguaccauccagacccucacgcuguuccugaccuccggcggggugcuccugagccuguacgucuccgccagccucuccuaccugcuguacagugacauccuccugaaguucuccaccaccgagaucacggccccgaccaugccccuggacugcgcgaacgccagcaacgugcaggccgugaaucgcuccgccaccaagggcgucacccuccugcugcccgagcccgaguggacguacccgcggcucagcugccccggguccaccuuccagaaggcccugcugaucucgccccaccgcuucggcgagaauaaggggaacuccgcgccccucaucauccgggagccguucaucgccugcggccccaacgagugcaagcacuucgcccugacccauuacgccgcgcagcccggcggguacuacaacggcacccgcggggaccggaacaagcugcgccaccucaucagugugaagcugggcaagauccccacgguggagaacuccaucuuccacauggccgccuggagcggguccgccugccacgauggcaaggaguggaccuacaucggcgucgacgggccggacaacaacgcccugcucaaggugaaguacggcgaggcguacaccgauaccuaccacucguacgccaacaagauccugcggacgcaggaguccgccugcaacuguaucgggggcaacugcuaccugaugaucaccgacggcagcgccagcgggguguccgagugccgcuuucucaagauccgggagggccgcaucaucaaggagaucuuccccaccgggcgggucaagcacaccgaggagugcacgugcggcuucgccucgaacaagaccaucgagugugcgugccgcgacaacuccuacaccgccaagcggcccuucgugaagcugaacguggagaccgauacggccgagauccgccugaugugcaccgacaccuaccucgacacgccccggccgaacgacgggagcaucaccggccccugugaguccgacggcgacaaggggagcggcgggaucaagggcggguucguccaccagcgcauggaguccaagaucggccggugguacucgcgcaccauguccaagaccgagcggaugggcauggggcuguaugugaaguacgacggcgaccccugggccgacagcgacgcccuggcguucuccggggugauggucaguaugaaggagcccggcugguacuccuucggguucgagaucaaggacaagaagugcgacgugccgugcaucggcaucgagauggugcaugacggcgggaaggagaccuggcacagcgccgccacggccaucuacugccucaugggcuccgggcagcugcugugggacaccgucaccggcguggacauggcccucuga

SEQ ID NO: 29720 - RNA, 1401 nt, Artificial Sequence; identical to SEQ ID NO: 29069
  derived and/or modified CDS sequence (AUadapt) from InfluenzaB__AGX21626__NA

SEQ ID NO: 29721 - RNA, 1401 nt, Artificial Sequence; identical to SEQ ID NO: 29069
  derived and/or modified CDS sequence (AUadapt) from InfluenzaB__AGX21637__NA

SEQ ID NO: 29722 - RNA, 1401 nt, Artificial Sequence; identical to SEQ ID NO: 29069
  derived and/or modified CDS sequence (AUadapt) from InfluenzaB__AGX21648__NA

SEQ ID NO: 29723 - RNA, 1401 nt, Artificial Sequence
  derived and/or modified CDS sequence (AUadapt) from InfluenzaB__AGX21659__NA
augcugcccaguaccauccagacccucacgcuguuccugaccuccggcggggugcuccugagccuguacgucuccgcccuccugagcuaccugcucuauuccgacauccugcugaaguucagcccgaccgagaucaccgcccccacgaugucccucgacugcgcgaacgccaguaacgugcaggccgugaaccgcuccgccaccaagggcgucaccuuccugcugcccgagcccgaguggaccuacccgcggcucagcugucccggguccacguuccagaaggcccugcugaucagcccccaccgcuucggcgagaccaaggggaacuccgcgccccucaucauccgggagccguucaucgccuguggccccaacgagugcaagcacuucgcccugacccacuaugccgcgcagcccggcggguacuacaacggcacccgcggggaccggaacaagcugcgccaccucgugagugugaagcugggcaagauccccacggucgagaacuccaucuuccacauggccgccuggagcggguccgccugccaugacggcaaggaguggaccuacaucggcguggacgggccggacaacgacgcccugcucaaggugaaguauggcgaggcguacaccgacaccuaccacagcuaugccaacaagauccugcggacgcaggaguccgccugcaacugcaucgggggcaacugcuaucugaugaucaccgacggcagcgccagcggggucuccgagugccgcuuccucaagauccgggagggccgcaucaucaaggagaucuuucccaccgggcgggugaagcacaccgaggagugcacgugcggcuucgccagcaacaagaccaucgagugugcgugccgcgacaacuccuacaccgccaagcggcccuucgugaagcugaaugucgagaccgacacggccgagauccgccugaugugcaccgacaccuaccucgacacgccccggccggacgaugggagcaucaccggccccugcgaguccaacggcgacaaggggagcggcgggaucaagggcggguuugugcaccagcgcauggaguccaagaucggccggugguacagccgcaccauguccaagaccgagcggaugggcauggggcuguacgugaaguacggcggggaccccugggccgauagcgacgcccuggcguucuccggcgucauggugagcaugaaggagcccgggugguacuccuuuggcuucgagaucaaggacaagaagugcgacgugccgugcaucggcaucgagaugguccacgaugggggcaaggagaccuggcacagcgccgccacggccaucuacugccucaugggguccggccagcugcugugggacaccgugaccggcguggacauggcccucuga

SEQ ID NO: 29724 - RNA, 1401 nt, Artificial Sequence
  derived and/or modified CDS sequence (AUadapt) from InfluenzaB__AGX21670__NA
augcugcccaguaccauccagacccucacgcuguuccugaccuccggcggggugcuccugagccuguacgucuccgcccuccugagcuaccugcucuauuccgacauccugcugaaguucagcccgaccgagaucaccgcccccacgaugucccucgacugcgcgaacgccaguaacgugcaggccgugaaccgcuccgccaccaagggcgucaccuuccugcugcccgagcccgaguggaccuacccgcggcucagcugccccggguccacguuucagaaggcccugcugaucucgccccaccgcuucggcgagaccaaggggaacuccgcgccccucaucauccgggagccguucaucgccugcggccccaaugagugcaagcacuucgcccugacccacuacgccgcgcagcccggcggguacuauaacggcacccgcggggaccggaacaagcugcgccaccucaucagcgugaagcugggcaagauccccacgguggagaacuccaucuuucacauggccgccuggagcggguccgccugccacgacggcaaggaguggaccuacaucggcgucgaugggccggacaacgacgcccugcucaaggugaaguacggcgaggcguacaccgacaccuaucacagcuacgccaacaagauccugcggacgcaggaguccgccugcaacuguaucgggggcaacugcuaccugaugaucaccgacggcagcgccagcgggguguccgagugucgcuuccucaagauccgggagggccgcaucaucaaggagaucuuccccaccgggcgggucaagcacaccgaggagugcacgugcggcuucgccaguaacaagaccaucgagugcgcgugccgcgacaacuccuacaccgccaagcggcccuuugugaagcugaacguggagaccgacacggccgagauccgccugaugugcaccgacaccuaccucgacacgccccggccggaugacgggagcaucaccggccccugcgaguccaacggcgacaaggggagcggcgggaucaagggcggguuuguccaccagcgcauggaguccaagaucggccggugguacagccgcaccauguccaagaccgagcggaugggcauggggcuguacgugaaguacgacggcgaucccugggccgacagcgacgcccuggcguucuccggggugauggucagcaugaaggagcccggcugguacuccuuuggguucgagaucaaggacaagaagugcgacgugccgugcaucggcaccgagauggugcacgauggcgggaaggagacguggcacagcgccgccaccgccaucuacugccucaugggcuccgggcagcugcugugggacaccgucaccggcguggacauggcccucuga

SEQ ID NO: 29725 - RNA, 1401 nt, Artificial Sequence
  derived and/or modified CDS sequence (AUadapt) from InfluenzaB__AGX21681__NA
augcugcccaguaccauccagaugcucacccuguuccugacguccggcggggugcuccugagccuguacgucuccgccucgcucuccuaccugcuguacagcgauauccuccugaaguucuccccgaccgagaucaccgcccccaccaugccccuggacugcgcgaacgccagcaacgugcacgccgugaaucgcuccgccacgaagggcgucaccuuccuccugcccgagccggaguggaccuacccccggcugucgugccccggguccaccuuccagaaggcccuccugaucagcccccaccgcuucggcgagacgaaggggaauuccgcgccgcugaucauccgggagcccuucaucgccugcggccccaacgagugcaagcacuucgcccucacccacuaugccgcgcagcccggcggguacuacaacggcacccgcggggaccggaacaagcugcgccaccugaucucggugaagcucggcaagaucccgaccguggagaacuccaucuuucacauggccgccuggagcggguccgccugccacgacggcaaggaguggacguacaucggcgucgacgggcccgauaacaacgcccugcugaagaucaaguacggcgaggcguacaccgacaccuaccacagcuaugccaacaacauccuccggacccaggaguccgccugcaacugcaucgggggcaacugcuaucugaugaucacggacggcucggccagcgggguguccgagugccgcuuccugaagauccgggagggccgcaucaucaaggagaucuuccccaccgggcgggugaagcacaccgaggagugcacguguggcuucgccucgaacaagaccaucgagugcgcgugccgcgacaacuccuauaccgccaagcggcccuucgucaagcucaacguggagaccgacaccgccgagauccgccugaugugcacggacaccuaccuggacaccccgcggcccgacgaugggagcaucaccggccccugcgaguccaacggcgacaaggggaacggcgggaucaagggcggguucgugcaccagcgcauggccaguaagaucggccggugguacucccgcacgaugucgaagaccgagcggaagggcauggggcucuacgucaaguacgacggcgaccccuggaccgacuccgacgcccuggcguuucgcggggugauggugagcaugaaggagccgggcugguacuccuucggguucgagaucaaggacaagaagugcgacguccccuguaucggcaucgagauggugcacgacggcgggaaggagaccuggcacagcgccgccacggccaucuacugccugaugggcuccgggcagcuccugugggacaccgugaccggcgucgacauggcccuguga

SEQ ID NO: 29726 - RNA, 1401 nt, Artificial Sequence; identical to SEQ ID NO: 28662
  derived and/or modified CDS sequence (AUadapt) from InfluenzaB__AGX21692__NA

SEQ ID NO: 29727 - RNA, 1401 nt, Artificial Sequence; identical to SEQ ID NO: 29235
  derived and/or modified CDS sequence (AUadapt) from InfluenzaB__AGX21703__NA

SEQ ID NO: 29728 - RNA, 1401 nt, Artificial Sequence
  derived and/or modified CDS sequence (AUadapt) from InfluenzaB__AGX21714__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccgcgaugccccuggacugcgccaacgccaguaacgugcaggccgugaaccgcuccgccacgaagggccucacccugcugcuccccgagccggaguggaccuacccccggcugagcugccccggguccaccuuucagaaggcgcugcucaucucgccccaccgcuucggcgagacgaaggggaacuccgccccgcugaucauccgggagcccuucaucgccugcggccccaaugagugcaagcacuucgcccugacccacuacgcggcccagcccggcggguauuacaacggcacccgcggggaccggaacaagcuccgccaccugaucagcgucaagcugggcaagaucccgaccguggagaauuccaucuuccacauggccgccuggagcggguccgccugccacgauggcaaggaguggacguacaucggcguggacgggcccgacaacaacgcgcuccugaaggucaaguacggcgaggccuauaccgacaccuaccacagcuacgccaauaagauccugcggacccaggaguccgccugcaacugcaucgggggcaacugcuaccucaugaucacggauggcagcgccagcgggguguccgagugccgcuuccugaagauccgggagggccgcaucaucaaggagaucuuccccaccgggcgggugaagcauaccgaggagugcacgugcggcuucgcgucgaacaagaccaucgagugcgccugucgcgacaacuccuacaccgccaagcggcccuucgucaagcugaacguggagaccgauaccgccgagauccgccucaugugcacggacaccuaccuggacaccccgcggcccaacgacgggaguaucaccggccccugcgaguccgacggcgacaaggggagcggcgggaucaagggcggguucgugcaucagcgcauggaguccaagaucggccggugguacagccgcacgauguccaagaccgagcggaugggcauggggcuguacgucaaguacgacggcgaccccugggccgauagcgacgcgcucgccuucuccggggugauggugagcaugaaggagccgggcugguacuccuuuggguucgagaucaaggacaagaagugcgacguccccugcaucggcaucgagauggugcacgauggcgggaaggagaccuggcacagcgccgccaccgccaucuacugccugaugggcuccgggcagcugcucugggacacggugaccggcgucgacauggcgcuguga

SEQ ID NO: 29729 - RNA, 1401 nt, Artificial Sequence
  derived and/or modified CDS sequence (AUadapt) from InfluenzaB__AGX21725__NA
augcugcccaguaccauccagaugcucacccuguuccugacguccggcggggugcuccugagccuguacgucuccgccagccucuccuaccugcuguacagugacauccuccugaaguucuccccgaccgagaucaccgcccccaccaugccccuggacugcgcgaacgccucgaaugugcacgccgugaaccgguccgccacgaagggcgucaccuuccuccugcccgagccggaguggaccuacccccggcugagcugccccggguccaccuuucagcgcgcccuccugaucagcccccaccgguucggcgagacgaaggggaacuccgcgccgcugaucauccgcgagcccuucaucgccugcggccccaaugagugcaagcacuucgcccucacccacuacgccgcgcagcccggcggguacuauaacggcacccgcggggaccggaacaagcugcggcaccugaucagcgugaagcucggcaagaucccgaccguggagaacuccaucuuucacauggccgccuggagcggguccgccugccacgacggcaaggaguggacguacaucggcgucgaugggcccgacaacaacgcccugcugaagaucaaguacggcgaggcguacaccgacaccuaucacucguacgccaacaacauccuccgcacccaggaguccgccugcaauugcaucgggggcaacugcuaccugaugaucacggacggcagcgccagugggguguccgagugccgguuccugaagauccgcgagggccggaucaucaaggagaucuuccccaccgggcgcgugaagcacaccgaggagugcacgugcggcuuugccagcaacaagaccaucgagugcgcgugccgggacaacuccuauaccgccaagcgccccuucgucaagcucaacguggagaccgacaccgccgagauccggcugaugugcacggacaccuaccuggauaccccgcgccccgacgacgggagcaucaccggccccugcgaguccaacggcgacaaggggaguggcgggaucaagggcggguucgugcaccagcggauggccuccaagaucggccgcugguacagccggacgauguccaagaccgagcgcaagggcauggggcucuacgucaaguacgauggcgaccccuggaccgacagcgacgcccuggcguuccgcggggugaugguguccaugaaggagccgggcugguacaguuucggguucgagaucaaggacaagaagugcgacguccccugcaucggcaucgagauggugcaugacggcgggaaggagaccuggcacuccgccgccacggccaucuacugccugaugggcagcgggcagcuccugugggacaccgugaccggcgucgacauggcccuguga

SEQ ID NO: 29730 - RNA, 1401 nt, Artificial Sequence
  derived and/or modified CDS sequence (AUadapt) from InfluenzaB__AGX21747__NA
augcugcccaguaccauccagacccucacgcuguuccugaccuccggcggggugcuccugagccuguacgucuccgccagccucuccuaucugcuguacagcgacauccuccugaaggugucccagaccgagaucaccgccccgacgaugccccuggacugcgcgaaugccagcaacgugcaggccgucaaccgcuccgccaccaagggcgugacccuccugcugcccgagcccgaguggaccuacccgcggcucucgugucccggguccacguuccagaaggcccugcugaucagcccccaccgcuucggcgagaccaaggggaacuccgcgccccucaucauccgggagccguuuaucgccugcggccccaaggagugcaagcacuucgcccugacccacuaugccgcgcagcccggcggguacuacaacggcacccgcgaggaccggaacaagcugcgccaucucaucagcgugaagcuggggaagauccccacggucgagaacuccaucuuccacauggccgccuggagcggcuccgccugucacgacgggcgggaguggaccuacaucggcguggacggcccggacaguaacgcccugcucaagaucaaguacggggaggcguacaccgacaccuaccauuccuacgccaagaacauccugcgcacgcaggagucggccugcaacuguaucggcggggacugcuaccugaugaucaccgacggcagcgccuccggcaucagugagugccgguuccucaagauccgcgaggggcggaucaucaaggagaucuuccccaccggccgcgugaagcacaccgaggagugcacguguggguucgccuccaacaagaccaucgagugcgcgugccgggacaauagcuacaccgccaagcgccccuucgucaagcugaacguggagaccgacacggccgagauccggcugauguguaccgagaccuaccucgacacgccccgcccggacgacggcuccaucaccgggcccugcgagaguaacggcgacaagggcuccgggggcaucaagggcggguucgugcaccagcggauggccucgaagaucgggcgcugguauucccggaccaugagcaagaccaagcgcaugggcaugggccuguacgucaaguacgacggggaccccuggaccgauuccgaggcccuggcgcucagcggcgugaugguguccauggaggagcccgggugguacagcuucggcuucgagaucaaggauaagaagugcgacgucccgugcaucgggaucgagauggugcacgacggcggcaagacgaccuggcauuccgccgccaccgccaucuacugccugauggggagcggccagcugcucugggacaccgugacgggggucgacauggcccuguga

SEQ ID NO: 29731 - RNA, 1401 nt, Artificial Sequence
  derived and/or modified CDS sequence (AUadapt) from InfluenzaB__AGX21758__NA
augcugcccaguaccauccagacccucacgcuguuccugaccuccggcggggugcuccugagccuguacgucuccgccucgcucuccuaccugcuguacagcgauauccuccugaaguucaccccgaccgagaucacggugcccaccaugccccuggacugcgccaacgcguccaacgugcaggccgucaaccgcagcgccaccaagggcgugacccuccugcugcccgagccggaguggacguauccccggcucuccugccccgggucgaccuuccagaaggcccugcugaucagcccccaccgcuucggcgagaccaaggggaacuccgccccgcucaucauccgggagcccuuuaucgcgugcggccccaaggagugcaagcacuucgcccugacccacuacgccgcccagcccggcggguacuauaacggcacgcgcgaggaccggaacaagcugcgccaccucaucuccgugaagcuggggaagaucccgaccgucgagaacagcaucuuccauauggcggccugguccggcucggccugccacgacgggaaggaguggaccuacaucggcguggacggccccgacuccaaugcccugcucaagaucaaguacggggaggccuacaccgacacguaccacagcuacgcgaauaacauccugcggacccaggaguccgccugcaacugcaucggcgggaacugcuaccugaugaucaccgauggcucggccagcggcaucuccgagugccgcuuccucaagauccgggaggggcgcaucaucaaggagaucuuccccaccggccgggugaagcacacggaggagugcacguguggguucgccagcaacaagaccaucgagugcgccugccgcgacaacuccuauaccgcgaagcggcccuucgucaagcugaacguggagaccgacaccgccgagauccgccugaugugcaccgagaccuaccucgacacgccgcggcccgacgauggcucgaucaccgggcccugcgaguccaacggcaacaagggcagcgggggcaucaagggcggguucgugcaccagcgcauggccuccaagaucgggcggugguauagccgcaccauguccaagaccaagcggaugggcaugggccuguacgucaaguacgacggggaccccuggacggacucggaugcccuggcccucuccggcgugauggugagcauggaggagccggggugguacuccuucggcuucgagaucaaggacaagaagugcgacguccccuguaucgggaucgagauggugcacgacggcggcaaggagaccuggcacagcgcggccaccgccaucuacugccugaugggguccggccagcugcucugggacaccgugacgggggucgacauggcccuguga

SEQ ID NO: 29732 - RNA, 1401 nt, Artificial Sequence
  derived and/or modified CDS sequence (AUadapt) from InfluenzaB__AGX21769__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgacgaugccccuggacugcgcgaaugccucgaacgugcaggccgccaaccgcuccgccaccaagggcgugacccuccugcugcccgagcccgaguggaccuacccgcggcucagcugucccggguccacguuccagaaggcgcugcugaucagcccccaccgcuucggcgagaccaaggggaacuccgcgccccucaucauccgggagccguucaucgccuguggccccaaggagugcaagcacuucgcccugacccacuacgccgcccagcccggcggguauuacaacggcacccgcgaggaccggaacaagcugcgccaccucaucagugucaagcuggggaagauccccacgguggagaacuccaucuuccacauggccgccuggucgggcuccgccugccacgaugggcgggaguggaccuacaucggcguggacggcccggacagcaacgcgcugcucaagaucaaguauggggaggccuacaccgacaccuaccacuccuacgccaagaauauccugcgcacgcaggagagcgccugcaacugcaucggcggggacugcuaucugaugaucaccgacggcagcgccuccggcaucucggagugccgguuccucaagauccgcgaggggcggaucaucaaggagaucuuucccaccggccgcgucaagcacaccgaggagugcacgugcggguucgcguccaacaagaccaucgagugugccugccgggacaacagcuacaccgccaagcgccccuucgugaagcugaauguggagaccgacacggccgagauccggcugaugugcaccaagaccuaccucgacacgccccgcccgaacgauggcuccaucaccgggcccugcgagagcgacggcgacaagggcuccgggggcaucaagggcggguucguccaucagcggauggccagcaagaucgggcgcugguacucccggaccaugucgaagaccaagcgcaugggcaugggccuguacgugaaguacgacggggaucccuggaccgacuccgaggcgcuggcccucagcggcgugauggucuccauggaggagcccgggugguacagcuucggcuuugagaucaaggacaagaagugcgacgugccgugcaucgggaucgagauggugcacgauggcggcaagacgaccuggcacuccgccgccaccgccaucuacugccugauggggagcggccagcugcucugggacaccgucacggggguggacauggcgcuguga

SEQ ID NO: 29733 - RNA, 1401 nt, Artificial Sequence
  derived and/or modified CDS sequence (AUadapt) from InfluenzaB__AGX21780__NA
augcugcccaguaccauccagacccucacgcuguuccugaccuccggcggggugcuccugagccuguacgucuccgccucgcucuccuaccugcuguacagugacauccuccugaaguucucccagaccgagaucaccgccccgacgaugccccuggacugcgcgaacgccagcaacgugcaggccgugaaucgcuccgccaccaagggcgucacccuccugcugcccgagcccgaguggaccuacccgcggcucucgugccccggguccacguuccagaaggcccugcugaucagcccccaccgcuuuggcgagaccaaggggaacuccgcgccccucaucauccgggagccguucaucgccugcggccccaaggagugcaagcacuucgcccugacccacuaugccgcgcagcccggcggguacuacaacggcacccgcgaggaccggaacaagcugcgccaccucaucagugugaagcuggggaagauccccacgguggagaacuccaucuuccacauggccgccuggucgggcuccgccugccacgacgggcgggaguggaccuauaucggcgucgacggcccggacagcaacgcccugcucaagaucaaguacggggaggcguacaccgauaccuaccacuccuacgccaagaacauccugcgcacgcaggagagcgccugcaacuguaucggcggggacugcuaccugaugaucaccgacggcucggccuccggcaucagcgagugucgguuccucaagauccgcgaggggcggaucaucaaggagaucuuccccaccggccgcgugaagcacaccgaggagugcacgugcggguucgccuccaacaagaccaucgagugugcgugccgggacaacagcuacaccgccaagcgccccuucgugaagcugaaugucgagaccgacacggccgagauccggcugaugugcaccgagaccuaccucgacacgccccgcccgaacgacggcuccaucaccgggcccugcgagaguaacggcgacaagggcuccgggggcaucaagggcggguucgugcaccagcggauggagagcaagaucgggcgcugguacucccggaccaugaguaagaccaagcgcaugggcaugggccuguacgugaaguacgacggggaccccuggaccgacuccgaggcccuggcccucucgggcgucaugguguccauggaggagcccgggugguacaguuucggcuucgagaucaaggacaagaagugcgacgugccgugcaucgggaucgagaugguccaugacggcggcaagacgaccuggcacuccgcggccaccgccaucuacugccugauggggagcggccagcugcucugggacaccgugacggggguggacaugacccuguga

SEQ ID NO: 29734 - RNA, 1401 nt, Artificial Sequence
  derived and/or modified CDS sequence (AUadapt) from InfluenzaB__AGX21791__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccgcuccgccaccaagggcgucacccuccugcugcccgagccggaguggaccuacccccggcucagcugccccggguccacguuccagaaggcccugcugaucucgccccaucgcuucggcgagaccaaggggaacuccgcgccgcucaucauccgggagcccuucaucgccugcggccccaaggagugcaagcacuuugcccugacccacuacgccgcgcagcccggcggguacuacagcggcacccgcggggaccggaacaagcugcgccaucucaucuccgugaagcugggcaagaucccgacgguggagaacagcaucuuccacauggccgccugguccgggucggccugccaugacggcaaggaguggaccuacaucggcgucgacgggcccgacaacaacgcccugcucaagaucaaguauggcgaggcguacaccgacaccuaccacuccuacgccaacaauauccugcggacgcaggagagcgccugcaacugcaucgggggcaacugcuaccugaugaucaccgauggcagcgccuccgggaucucggagugccgcuuccucaagauccgggagggccgcaucaucaaggagaucuuccccaccgggcgggugaagcacaccgaggaguguacgugcggcuucgccuccaacaagaccaucgagugcgcgugccgcgacaauaacuacaccgccaagcggcccuucgugaagcugaacgucgagaccgacacggccgagauccgccugaugugcaccgagaccuaucucgacaccccgcggcccgacgacgggagcaucacgggccccugcgaguccaacggcgacaaggggaguggcgggaucaagggcggguucgugcaccagcgcauggccuccaagaucggccggugguacucgcgcaccauguccaagaacaagcggaugggcauggggcuguacgugaaguaugacggcgaccccugggccgacagcgacgcgcuggcccucuccggggucauggugagcauggaggagccgggcugguauuccuucggguucgagaucaaggacaagaagugcgacgugcccugcaucggcaucgagaugguccaugacggcgggaaggagaccuggcacagcgccgccaccgccaucuacugccugaugggcuccgggcagcugcucugggacacggugaccggcguggacauggcgcuguga

SEQ ID NO: 29735 - RNA, 1401 nt, Artificial Sequence
  derived and/or modified CDS sequence (AUadapt) from InfluenzaB__AGX21802__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgacgaugccccuggacugcgcgaaugccagcaacgugcaggccgccaaccgcuccgccaccaagggcgugacccuccugcugcccgagcccgaguggaccuacccgcggcucucgugucccggguccacguuccagaaggcgcugcugaucagcccccaccgcuucggcgagaccaaggggaacuccgcgccccucaucauccgggagccguuuaucgccugcggccccaaggagugcaagcacuucgcccugacccacuaugccgcccagcccggcggguacuacaacggcacccgcgaggaccggaacaagcugcgccaucucaucagcgucaagcuggggaagauccccacgguggagaacuccaucuuccacauggccgccuggagcggcuccgccugucacgacgggcgggaguggaccuacaucggcguggacggcccggacaguaacgcgcugcucaagaucaaguacggggaggccuacaccgacaccuaccauuccuacgccaagaacauccugcgcacgcaggagucggccugcaacuguaucggcggggacugcuaccugaugaucaccgacggcagcgccuccggcaucagugagugccgguuccucaagauccgcgaggggcggaucaucaaggagaucuuccccaccggccgcgucaagcacaccgaggagugcacguguggguucgcguccaacaagaccaucgagugcgccugccgggacaauagcuacaccgccaagcgccccuucgugaagcugaacguggagaccgacacggccgagauccggcugauguguaccgagaccuaccucgacacgccccgcccgaacgacggcuccaucaccgggcccugcgagagugacggcgacaagggcuccgggggcaucaagggcggguucguccaccagcggauggccucgaagaucgggcgcugguauucccggaccaugagcaagaccaagcgcaugggcaugggccuguacgugaaguacgacggggaccccuggaccgauuccgaggcgcuggcccucagcggcgugauggucuccauggaggagcccgggugguacagcuucggcuucgagaucaaggauaagaagugcgacgugccgugcaucgggaucgagauggugcacgacggcggcaagacgaccuggcauuccgccgccaccgccaucuacugccugauggggagcggccagcugcucugggacaccgucacggggguggacauggcgcuguga

SEQ ID NO: 29736 - RNA, 1401 nt, Artificial Sequence
  derived and/or modified CDS sequence (AUadapt) from InfluenzaB__AGX21813__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaagaugccccuggacugcgcgaaugccucgaacgugcaggccgccaaccgcuccgccacgaagggcgugacccuccugcugcccgagcccgaguggaccuacccgcggcucagcugucccggguccaccuuccagaaggcgcugcugaucagcccccaccgcuucggcgagacgaaggggaacuccgcgccccucaucauccgggagccguucaucgccuguggccccaaggagugcaagcacuucgcccugacccacuacgccgcccagcccggcggguauuacaacggcacccgcgaggaccggaacaagcugcgccaccucaucagugucaagcuggggaagauccccaccguggagaacuccaucuuccacauggccgccuggucgggcuccgccugccacgaugggcgggaguggacguacaucggcguggacggcccggacagcaacgcgcugcucaagaucaaguauggggaggccuacaccgacaccuaccacuccuacgccaagaauauccugcgcacccaggagagcgccugcaacugcaucggcggggacugcuaucugaugaucacggacggcagcgccuccggcaucucggagugccgguuccucaagauccgcgaggggcggaucaucaaggagaucuuucccaccggccgcgucaagcacaccgaggagugcacgugcggguucgcguccaacaagaccaucgagugugccugccgggacaacagcuacaccgccaagcgccccuucgugaagcugaauguggagaccgacaccgccgagauccggcugaugugcacggagaccuaccucgacacgccccgcccgaacgauggcuccaucaccgggcccugcgagagcgacggcgacaagggcuccgggggcaucaagggcggguucguccaucagcggauggccagcaagaucgggcgcugguacucccggaccaugucgaagaccaagcgcaugggcaugggccuguacgugaaguacgacggggaucccuggaccgacuccgaggcgcuggcccucagcggcgugauggucuccauggaggagcccgggugguacagcuucggcuuugagaucaaggacaagaagugcgacgugccgugcaucgggaucgagauggugcacgauggcggcaagaccacguggcacuccgccgccaccgccaucuacugccugauggggagcggccagcugcucugggacaccgucaccgggguggacauggcgcuguga

SEQ ID NO: 29737 - RNA, 1401 nt, Artificial Sequence
  derived and/or modified CDS sequence (AUadapt) from InfluenzaB__AGX21824__NA
augcugcccaguaccauccagacccucacgcuguuccugaccuccggcggggugcuccugagccuguacgucuccgccagccucuccuaccugcuguacagugacauccuccugaaguucucccagaccgagaucaccgccccgaucaugccccuggacugcgcgaacgccagcaaugugcaggccgugaaccgcuccgccacgaagggcgucacccuccugcugcccgagcccgaguggaccuacccgcggcucagcugccccggguccaccuuccagaaggcccugcugaucagcccccaucgcuucggcgagacgaaggggaacuccgcgccccucaucauccgggagccguucaucgccugcggccccaaggagugcaagcacuuugcccugacccacuacgccgcgcagcccggcggguacuacaacggcacccgcgaggaccggaauaagcugcgccaccucaucucggugaagcuggggaagauccccaccguggagaacuccaucuuccacauggccgccuggagcggcuccgccugucacgacgggcgggaguggacguacaucggcgucgacggcccggacagcaaugcccugcucaagaucaaguacggggaggcguacaccgacaccuaccacuccuacgccaagaauauccugcgcacccaggagagcgccugcaacugcaucggcggggacugcuaucugaugaucacggacggccccgccucgggcaucuccgagugccgguuccucaagauccgcgaggggcggaucaucaaggagaucuuccccaccggccgcgugaagaacaccgaggaguguacgugcggguucgccagcaacaagaccaucgagugcgcgugccgggauaacuccuacaccgccaagcgccccuucgugaagcugaacgucgagaccgacaccgccgagauccggcugaugugcacggagaccuaucucgacaccccgcgccccaacgacggcagcaucaccgggcccugcgaguccaacggcgauaagggcagcgggggcaucaagggcggguucgugcaccagcggauggccuccaagaucgggcgcugguacucgcggacgauguccaagaccaagcgcaugggcaugggccuguacgugaaguaugacggggaccccuggaccgacagcgaggcccuggcgcucuccggcgucauggugagcauggaggagccggggugguacuccuuuggcuucgagaucaaggacaagaagugcgacgugcccugcaucgggaucgagaugguccacgauggcggcaagaccacguggcacagcgccgccaccgccaucuacugccugaugggguccggccagcugcucugggacaccgugaccgggguggacauggcccuguga

SEQ ID NO: 29738 - RNA, 1401 nt, Artificial Sequence; identical to SEQ ID NO: 28856
  derived and/or modified CDS sequence (AUadapt) from InfluenzaB__AGX21835__NA

SEQ ID NO: 29739 - RNA, 1401 nt, Artificial Sequence; identical to SEQ ID NO: 29244
  derived and/or modified CDS sequence (AUadapt) from InfluenzaB__AGX21846__NA

SEQ ID NO: 29740 - RNA, 1401 nt, Artificial Sequence; identical to SEQ ID NO: 29244
  derived and/or modified CDS sequence (AUadapt) from InfluenzaB__AGX21857__NA

SEQ ID NO: 29741 - RNA, 1401 nt, Artificial Sequence; identical to SEQ ID NO: 28856
  derived and/or modified CDS sequence (AUadapt) from InfluenzaB__AGX21868__NA

SEQ ID NO: 29742 - RNA, 1401 nt, Artificial Sequence; identical to SEQ ID NO: 29242
  derived and/or modified CDS sequence (AUadapt) from InfluenzaB__AGX21879__NA

SEQ ID NO: 29743 - RNA, 1401 nt, Artificial Sequence
  derived and/or modified CDS sequence (AUadapt) from InfluenzaB__AGX21890__NA
augcugcccaguaccauccagacccucacgcuguuccugaccuccggcggggugcuccugagccuguacgucuccgccagccucuccuaccugcuguacagugacauccuccugaaguucucccagaccgagaucaucgccccgaucaugccccuggacugcgcgaacgccagcaacgugcaggccgugaaucacuccgccaccaagggcgucacgcuccugcugcccgagcccgaguggaccuacccgcgccucagcugccccggguccaccuuccagaaggcccugcugaucagcccccaucgguucggcgagaccaaggggaacuccgcgccccucaucauccgcgagccguucaucgccugcggccccaaggagugcaagcacuucgcccugacgcauuacgccgcgcagcccggcggguacuacaacggcacccgggaggaccgcaacaagcugcggcaucucaucucggugaagcuggggaagauccccaccguggagaacuccaucuuccacauggccgccuggagcggcuccgccugccacgaugggcgcgaguggaccuacaucggcgucgacggcccggacagcaacgcccugcucaagaucaaguacggggaggcguauacggacaccuaccacuccuacgccaagaacauccugcggacccaggagagcgccugcaauugcaucggcggggacugcuaccugaugaucaccgacggccccgccucgggcaucuccgagugucgcuuccucaagauccgggaggggcgcaucaucaaggagaucuuccccacgggccgggugaagcacaccgaggagugcacgugcggguucgccagcaauaagaccaucgagugcgcgugccgcgacaacuccuacaccgccaagcggcccuucgugaagcugaaugucgagaccgacaccgccgagauccgccugaugugcaccgagacguaccucgacaccccgcggcccaacgacggcagcaucaccgggcccugugaguccaacggcgacaagggcagcgggggcaucaagggcggguucgugcaccagcgcauggccuccaagaucgggcggugguacagucgcaccauguccaagacgaagcggaugggcaugggccuguacgugaaguacgacggggaccccuggaccgacagcgaggcccuggcgcucuccggcgucauggugagcauggaggagccggggugguauuccuucggcuucgagaucaaggacaagaagugcgacgugcccugcaucgggaucgagaugguccaugacggcggcaagaccaccuggcacagcgccgccacggccaucuacugccugaugggguccggccagcugcucugggacaccgugaccgggguggacauggcccuguga

SEQ ID NO: 29744 - RNA, 1401 nt, Artificial Sequence; identical to SEQ ID NO: 28856
  derived and/or modified CDS sequence (AUadapt) from InfluenzaB__AGX21901__NA

SEQ ID NO: 29745 - RNA, 1401 nt, Artificial Sequence; identical to SEQ ID NO: 28856
  derived and/or modified CDS sequence (AUadapt) from InfluenzaB__AGX21912__NA

SEQ ID NO: 29746 - RNA, 1401 nt, Artificial Sequence
  derived and/or modified CDS sequence (AUadapt) from InfluenzaB__AGX21923__NA
augcugcccaguaccauccagacccucacgcuguuccugaccuccggcggggugcuccugagccuguacgucuccgccagccucuccuaccugcuguacagugacauccuccugaaguucucccagaccgagaucaccgccccgaucaugccccuggacugcacgaacgcgagcaaugugcaggccgugaaccgcuccgccaccaagggcgucacccuccugcugcccgagcccgaguggaccuacccgcggcucagcugccccggguccacguuccagaaggcccugcugaucagcccccaucgcuucggcgagaccaaggggaacuccgcgccccucaucauccgggagccguucaucgccugcggccccaaggagugcaagcacuuugcccugacccacuacgccgcccagcccggcggguacuacaacggcacccgcgaggaccggaauaagcugcgccaccucaucucggugaagcuggggaagauccccacgguggagaacuccaucuuccacauggcggccuggagcggcuccgccugucacgacgggcgggaguggaccuacaucggcgucgacggcccggacagcaaugcccugcucaagaucaaguacggggaggccuacaccgacaccuaccacuccuacgcgaagaauauccugcgcacgcaggagagcgccugcaacugcaucggcggggacugcuaucugaugaucaccgacggccccgccucgggcaucuccgagugccgguuccucaagauccgcgaggggcggaucaucaaggagaucuuccccaccggccgcgugaagcacaccgaggaguguacgugcggguucgccagcaacaagaccaucgagugcgccugccgggauaacuccuacaccgcgaagcgccccuucgugaagcugaacgucgagaccgacacggccgagauccggcugaugugcaccgagaccuaucucgacaccccgcgccccaacgacggcagcaucacggggcccugcgaguccaacggcgauaagggcagcgggggcaucaagggcggguucgugcaccagcggauggccuccaagaucgggcgcugguacucgcggaccauguccaagaccaagcgcaugggcaugggccuguacgugaaguaugacggggaccccuggaccgacagcgaggcccuggcccucuccggcgucauggugagcauggaggagccggggugguacuccuuuggcuucgagaucaaggacaagaagugcgacgugcccugcaucgggaucgagaugguccacgauggcggcaagacgaccuggcacagcgcggccaccgccaucuacugccugaugggguccggccagcugcucugggacaccgugacggggguggacauggcccuguga

SEQ ID NO: 29747 - RNA, 1401 nt, Artificial Sequence; identical to SEQ ID NO: 29743
  derived and/or modified CDS sequence (AUadapt) from InfluenzaB__AGX21934__NA

SEQ ID NO: 29748 - RNA, 1401 nt, Artificial Sequence; identical to SEQ ID NO: 29244
  derived and/or modified CDS sequence (AUadapt) from InfluenzaB__AGX21945__NA

SEQ ID NO: 29749 - RNA, 1401 nt, Artificial Sequence
  derived and/or modified CDS sequence (AUadapt) from InfluenzaB__AGX21956__NA
augcugcccaguaccauccagacccucacgcuguuccugaccuccggcggggugcuccugagccuguacgucuccgccagccucuccuaccugcuguacagugacauccuccugaaguucucccagaccgagaucaccgccccgaucaugccccuggacugcgcgaacacgagcaauauccaggccgugaaccgcuccgccaccaagggcgugacccuccugcugcccgagcccgaguggaccuacccgcggcucagcugccccggguccacguuccagaaggcccugcugaucucgccccaccgcuuuggcgagaccaaggggaacuccgcgccccucaucauccgggagccguucaucgccugcggccccaaggagugcaagcacuucgcccugacccauuacgccgcccagcccggcggguacuacaacggcacccgcgaggaccggaacaagcugcgccaccucaucagugucaagcuggggaagauccccacgguggagaacuccaucuuccacauggcggccuggagcggcuccgccugccacgaugggcgggaguggaccuacaucggcguggacggcccggacucgaacgcccugcucaagaucaaguacggggaggccuacaccgauaccuaccacuccuacgcgaagaacauccugcgcacgcaggagagcgccugcaauugcaucggcggggacugcuaccugaugaucaccgacggccccgccagcggcaucuccgagugucgguuccucaagauccgcgaggggcggaucaucaaggagaucuuccccaccggccgcgucaagcacaccgaggagugcacgugcggguucgccucgaauaagaccaucgagugcgccugccgggacaacuccuacaccgcgaagcgccccuucgugaagcugaauguggagaccgacacggccgagauccggcugaugugcaccgagaccuaccucgacaccccgcgccccaacgacggcagcaucacggggcccugugaguccaacggcgacaagggcagcgggggcaucaagggcggguucguccaccagcggauggccuccaagaucgggcgcugguacagucggaccauguccaagaccaagcgcaugggcaugggccuguacgugaaguacgacggggaccccuggaccgacagcgaggcccuggcccucuccggcgugauggucagcauggaggagccggggugguauuccuucggcuucgagaucaaggacaagaagugcgacgugcccugcaucgggaucgagauggugcaugacggcggcaagacgaccuggcacagcgcggccaccgccaucuacugccugaugggguccggccagcugcucugggacaccgucacggggguggacauggcccuguga

SEQ ID NO: 29750 - RNA, 1401 nt, Artificial Sequence; identical to SEQ ID NO: 29244
  derived and/or modified CDS sequence (AUadapt) from InfluenzaB__AGX21967__NA

SEQ ID NO: 29751 - RNA, 1401 nt, Artificial Sequence; identical to SEQ ID NO: 28856
  derived and/or modified CDS sequence (AUadapt) from InfluenzaB__AGX21978__NA

SEQ ID NO: 29752 - RNA, 1401 nt, Artificial Sequence; identical to SEQ ID NO: 29244
  derived and/or modified CDS sequence (AUadapt) from InfluenzaB__AGX21989__NA

SEQ ID NO: 29753 - RNA, 1401 nt, Artificial Sequence; identical to SEQ ID NO: 29242
  derived and/or modified CDS sequence (AUadapt) from InfluenzaB__AGX22000__NA

SEQ ID NO: 29754 - RNA, 1401 nt, Artificial Sequence
  derived and/or modified CDS sequence (AUadapt) from InfluenzaB__AGX22011__NA
augcugcccaguaccauccagacccucacgcuguuccugaccuccggcggggugcuccugagccuguacgucuccgccucgcucuccuaccugcuguacagugacauccuccugaaguucucccagaccgagaucaccgccccgaucaugccccuggacugcgcgaacgccagcaacgugcaggccgugaaucgcuccgccacgaagggcgucacccuccugcugcccgagcccgaguggaccuacccgcggcucucgugccccggguccaccuuccagaaggcccugcugaucagcccccaccgcuuuggcgagacgaaggggaacuccgcgccccucaucauccgggagccguucaucgccugcggccccaaggagugcaagcacuucgcccugacccacuaugccgcgaagcccggcggguacuacaacggcacccgcgaggaccggaacaagcugcgccaccucaucagugugaagcuggggaagauccccaccguggagaacuccaucuuccacauggccgccuggucgggcuccgccugccacgacgggcgggaguggacguauaucggcgucgacggcccggacagcaacgcccugcucaagaucaaguacggggaggcguacaccgauaccuaccacuccuacgccaagaacauccugcgcacccaggagucggccugcaacuguaucggcggggacugcuaccugaugaucacggacggccccgccagcggcaucuccgagugccgguuucucaagauccgcgaggggcggaucaucaaggagaucuuccccaccggccgcgugaagcacaccgaggagugcacgugcggguucgccagcaacaagaccaucgagugugcgugccgggacaacaacuacaccgccaagcgccccuucgugaagcugaaugucgagaccgacaccgccgagauccggcugaugugcacggagaccuaccucgacaccccgcgccccaacgacggcuccaucaccgggcccugcgagaguaacggcgacaagggcuccgggggcaucaagggcggguucgugcaccagcggauggccagcaagaucgggcgcugguacucccggacgaugaguaagaccaagcgcaugggcaugggccuguacgugaaguacgacggggaccccuggaccgacuccgaggcccuggcgcucucgggcgucaugguguccauggaggagccggggugguacaguuucggcuucgagaucaaggacaagaagugcgacgugcccugcaucgggaucgagaugguccaugacggcggcaagaccacguggcacuccgccgccaccgccaucuacugccugauggggagcggccagcugcucugggacaccgugaccgggguggacauggcccuguga

SEQ ID NO: 29755 - RNA, 1401 nt, Artificial Sequence; identical to SEQ ID NO: 28856
  derived and/or modified CDS sequence (AUadapt) from InfluenzaB__AGX22033__NA

SEQ ID NO: 29756 - RNA, 1401 nt, Artificial Sequence; identical to SEQ ID NO: 28856
  derived and/or modified CDS sequence (AUadapt) from InfluenzaB__AGX22044__NA

SEQ ID NO: 29757 - RNA, 1401 nt, Artificial Sequence; identical to SEQ ID NO: 29242
  derived and/or modified CDS sequence (AUadapt) from InfluenzaB__AGX22055__NA

SEQ ID NO: 29758 - RNA, 1401 nt, Artificial Sequence; identical to SEQ ID NO: 28856
  derived and/or modified CDS sequence (AUadapt) from InfluenzaB__AGX22066__NA

SEQ ID NO: 29759 - RNA, 1401 nt, Artificial Sequence; identical to SEQ ID NO: 29743
  derived and/or modified CDS sequence (AUadapt) from InfluenzaB__AGX22077__NA

SEQ ID NO: 29760 - RNA, 1401 nt, Artificial Sequence; identical to SEQ ID NO: 28858
  derived and/or modified CDS sequence (AUadapt) from InfluenzaB__AGX22088__NA

SEQ ID NO: 29761 - RNA, 1401 nt, Artificial Sequence; identical to SEQ ID NO: 29244
  derived and/or modified CDS sequence (AUadapt) from InfluenzaB__AGX22099__NA

SEQ ID NO: 29762 - RNA, 1401 nt, Artificial Sequence; identical to SEQ ID NO: 29242
  derived and/or modified CDS sequence (AUadapt) from InfluenzaB__AGX22110__NA

SEQ ID NO: 29763 - RNA, 1401 nt, Artificial Sequence; identical to SEQ ID NO: 29244
  derived and/or modified CDS sequence (AUadapt) from InfluenzaB__AGX22132__NA

SEQ ID NO: 29764 - RNA, 1401 nt, Artificial Sequence
  derived and/or modified CDS sequence (AUadapt) from InfluenzaB__AGX22143__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaacgccaguaacgugcaggccgugaaccgcuccgccacgaagggcgucacccuccugcugcccgagcccgaguggaccuacccgcggcucagcugccccggguccaccuuucagaaggcccugcugaucagcccccaccgcuucggcgagacgaaggggaacuccgcgccccucaucauccgggagccguucaucgccugcggccccaaggaguguaagcacuucgcccugacccacuacgccgcgcagcccggcggguacuacaauggcacccgcgaggaccggaacaagcugcgccaccucaucagcgugaagcuggggaagauccccaccguggagaacuccaucuuucacauggccgccuggagcggcuccgccugccacgacgggcgggaguggacguacaucggcgucgauggcccggacucgaacgcccugcucaagaucaaguacggggaggcguacaccgauaccuaccacuccuacgccaagaacauccugcgcacccaggagagcgccugcaauugcaucggcggggacugcuaccugaugaucacggacggccccgccagcggcaucuccgagugucgguuccucaagauccgcgaggggcggaucaucaaggagaucuuccccaccggccgcgugaagcacaccgaggagugcacgugcggguuugccagcaacaagaccaucgagugcgcgugccgggacaacuccuauaccgccaagcgccccuucgugaagcugaacgucgagaccgacaccgccgagauccggcugaugugcacggagaccuaccucgauaccccgcgccccaacgacggcagcaucaccgggcccugcgaguccaacggcgacaagggcagugggggcaucaagggcggguucgugcaccagcggauggccuccaagaucgggcgcugguacagccggacgaucuccaagaccaagcgcaugggcaugggccuguacgugaaguacgauggggaccccuggaccgacagcgaggcccuggcgcucuccggcgucauggugagcauggaggagccggggugguacuccuuuggcuucgagaucaaggacaagaagugcgacgugcccugcaucgggaucgagaugguccacgauggcggcaagaccacguggcacagcgccgccaccgccaucuacugccugaugggguccggccagcugcucugggacaccgugaccgggguggacauggcccuguga

SEQ ID NO: 29765 - RNA, 1401 nt, Artificial Sequence; identical to SEQ ID NO: 29764
  derived and/or modified CDS sequence (AUadapt) from InfluenzaB__AGX22154__NA

SEQ ID NO: 29766 - RNA, 1401 nt, Artificial Sequence; identical to SEQ ID NO: 29764
  derived and/or modified CDS sequence (AUadapt) from InfluenzaB__AGX22165__NA

SEQ ID NO: 29767 - RNA, 1401 nt, Artificial Sequence; identical to SEQ ID NO: 29743
  derived and/or modified CDS sequence (AUadapt) from InfluenzaB__AGX22176__NA

SEQ ID NO: 29768 - RNA, 1401 nt, Artificial Sequence; identical to SEQ ID NO: 29764
  derived and/or modified CDS sequence (AUadapt) from InfluenzaB__AGX22187__NA

SEQ ID NO: 29769 - RNA, 1401 nt, Artificial Sequence; identical to SEQ ID NO: 29764
  derived and/or modified CDS sequence (AUadapt) from InfluenzaB__AGX22198__NA

SEQ ID NO: 29770 - RNA, 1401 nt, Artificial Sequence; identical to SEQ ID NO: 29764
  derived and/or modified CDS sequence (AUadapt) from InfluenzaB__AGX22209__NA

SEQ ID NO: 29771 - RNA, 1401 nt, Artificial Sequence; identical to SEQ ID NO: 29242
  derived and/or modified CDS sequence (AUadapt) from InfluenzaB__AGX22220__NA

SEQ ID NO: 29772 - RNA, 1401 nt, Artificial Sequence; identical to SEQ ID NO: 29244
  derived and/or modified CDS sequence (AUadapt) from InfluenzaB__AGX22231__NA

SEQ ID NO: 29773 - RNA, 1401 nt, Artificial Sequence; identical to SEQ ID NO: 29743
  derived and/or modified CDS sequence (AUadapt) from InfluenzaB__AGX22242__NA

SEQ ID NO: 29774 - RNA, 1401 nt, Artificial Sequence; identical to SEQ ID NO: 29242
  derived and/or modified CDS sequence (AUadapt) from InfluenzaB__AGX22253__NA

SEQ ID NO: 29775 - RNA, 1401 nt, Artificial Sequence; identical to SEQ ID NO: 28856
  derived and/or modified CDS sequence (AUadapt) from InfluenzaB__AGX22264__NA

SEQ ID NO: 29776 - RNA, 1401 nt, Artificial Sequence; identical to SEQ ID NO: 29242
  derived and/or modified CDS sequence (AUadapt) from InfluenzaB__AGX22275__NA

SEQ ID NO: 29777 - RNA, 1401 nt, Artificial Sequence; identical to SEQ ID NO: 28856
  derived and/or modified CDS sequence (AUadapt) from InfluenzaB__AGX22286__NA

SEQ ID NO: 29778 - RNA, 1401 nt, Artificial Sequence
  derived and/or modified CDS sequence (AUadapt) from InfluenzaB__AGX22297__NA
augcugcccaguaccauccagacccucacgcuguuccugacccucggcggggugcugcugucccucuacgucagcgccucccugagcuaccugcucuauuccgacauccugcugaaguucagccagaccgagaucaccgccccgaucaugccccucgacugcgcgaacgccuccaaugugcaggccgugaaccgcucggccacgaagggcgucacccugcugcuccccgagcccgaguggaccuacccgcggcuguccugccccgggagcaccuuucagaaggcccugcucaucagcccccaccgcuucggcgagacgaaggggaacuccgcgccccugaucauccgggagccguucaucgccugcggccccaaggaguguaagcacuucgcccugacccacuacgccgcgcagcccggcggguacuacaauggcacccgcgaggaccggaacaagcuccgccaccugaucuccgugaagcuggggaagauccccaccguggagaacagcaucuuucacauggccgccugguccggcagcgccugccacgacgggcgggaguggacguacaucggcgucgauggcccggacuccaacgcccuccugaagaucaaguacggggaggcguacaccgacaccuaucacucguacgccaagaacauccugcgcacccaggaguccgccugcaacuguaucggcggggacugcuaccucaugaucacggacggccccgccagcggcaucagcgagugucgguuccugaagauccgcgaggggcggaucaucaaggagaucuuccccaccggccgcgugaagcacaccgaggagugcacgugcggguuugccuccaacaagaccaucgagugcgcgugccgggacaacagcuauaccgccaagcgccccuucgugaagcugaacgucgagaccgacaccgccgagauccggcucaugugcacggagaccuaccuggauaccccgcgccccaacgacggcuccaucaccgggcccugcgagagcaacggcgacaagggcuccgggggcaucaagggcggguuugugcaccagcggauggccucgaagaucgggcgcugguacucccggacgaugagcaagaccaagcgcaugggcaugggccuguacgugaaguacgauggggaccccuggaccgacuccgaggcccucgcgcugagcggcgucaugguguccauggaggagccggggugguacagcuuuggcuucgagaucaaggacaagaagugcgacgugcccugcaucgggaucgagaugguccacgauggcggcaagaccacguggcacuccgccgccaccgccaucuacugccugauggggagcggccagcuccugugggacaccgugaccgggguggacauggcccuguga

SEQ ID NO: 29779 - RNA, 1401 nt, Artificial Sequence; identical to SEQ ID NO: 28856
  derived and/or modified CDS sequence (AUadapt) from InfluenzaB__AGX22308__NA

SEQ ID NO: 29780 - RNA, 1401 nt, Artificial Sequence
  derived and/or modified CDS sequence (AUadapt) from InfluenzaB__AGX22330__NA
augcugcccaguaccauccagacccucacgcuguuccugaccuccggcggggugcuccugagccuguacgucuccgccucgcucuccuaccugcuguacagugacauccuccugaaguucucccagaccgagaucaccgccccgaucaugccccuggacugcgcgaacgccagcaaugugcaggccgugaaccgcuccgccacgaagggcgucacccuccugcugcccgagcccgaguggaccuacccgcggcucucgugccccggguccaccuuccagaaggcccugcugaucagcccccaccgcuuuggcgagacgaaggggaacuccgcgccccucaucauccgggagccguucaucgccugcggccccaaggagugcaagcacuucgcccugacccauuacgccgcgcagcccggcggguacuacaacggcacccgcgaggaccggaacaagcugcgccaccucaucagugugaagcuggggaagauccccaccguggagaacuccaucuuccacaugacggccuggucgggcuccgccugccacgaugggaaggaguggaccuacaucggcgucgacggcccggacagcaacgcccugcucaagaucaaguacggggaggccuacaccgauaccuaccacuccuacgcgaagaacauccugcggacgcaggagucggccugcaauugcaucggcggggacugcuaccugaugaucaccgacggccccgccagcggcaucuccgagugucgcuuccucaagauccgggaggggcgcaucaucaaggagaucuuccccaccggccgggugaagcacaccgaggagugcacgugcggguucgccagcaauaagaccaucgagugcgccugccgcgacaacuccuacaccgcgaagcggcccuucgugaagcugaaugucgagaccgacacggccgagauccgccugaugugcaccgagaccuaccucgacaccccgcggcccaacgacggcucgaucacggggcccugugaguccgacggcgacaagggcagcgggggcaucaagggcggguucgugcaccagcgcauggccaccaagaucgggcggugguacucccgcaccaugaguaagaccaagcggaugggcaugggccuguacgugaaguacgacggggaccccuggacggacuccgaggcccuggcccucucgggcgucaugguguccauggaggagccggggugguacaguuucggcuucgagaucaaggacaagaagugcgacgugcccugcaucgggaucgagaugguccaugacggcggcaagaccaccuggcacuccgcggccaccgccaucuacugccugauggggagcggccagcugcucugggacacggugaccgggguggacauggcccuguga

SEQ ID NO: 29781 - RNA, 1401 nt, Artificial Sequence; identical to SEQ ID NO: 29244
  derived and/or modified CDS sequence (AUadapt) from InfluenzaB__AGX22341__NA

SEQ ID NO: 29782 - RNA, 1401 nt, Artificial Sequence; identical to SEQ ID NO: 29244
  derived and/or modified CDS sequence (AUadapt) from InfluenzaB__AGX22352__NA

SEQ ID NO: 29783 - RNA, 1401 nt, Artificial Sequence; identical to SEQ ID NO: 29244
  derived and/or modified CDS sequence (AUadapt) from InfluenzaB__AGX22363__NA

SEQ ID NO: 29784 - RNA, 1401 nt, Artificial Sequence; identical to SEQ ID NO: 29242
  derived and/or modified CDS sequence (AUadapt) from InfluenzaB__AGX22374__NA

SEQ ID NO: 29785 - RNA, 1401 nt, Artificial Sequence; identical to SEQ ID NO: 28856
  derived and/or modified CDS sequence (AUadapt) from InfluenzaB__AGX22385__NA

SEQ ID NO: 29786 - RNA, 1401 nt, Artificial Sequence; identical to SEQ ID NO: 28856
  derived and/or modified CDS sequence (AUadapt) from InfluenzaB__AGX22396__NA

SEQ ID NO: 29787 - RNA, 1401 nt, Artificial Sequence; identical to SEQ ID NO: 29743
  derived and/or modified CDS sequence (AUadapt) from InfluenzaB__AGX22407__NA

SEQ ID NO: 29788 - RNA, 1401 nt, Artificial Sequence
  derived and/or modified CDS sequence (AUadapt) from InfluenzaB__AGX22418__NA
augcugcccaguaccauccagacccucacgcuguuccugaccuccggcggggugcuccugagccuguacgucuccgccagccucuccuaccugcuguacagugacauccuccugaaguucucccagaccgagaucaucgccccgaucaugccccuggacugcgcgaacgccagcaacgugcaggccgugaaucacuccgccaccaagggcgucacgcuccugcugcccgagcccgaguggaccuacccgcgccucagcugccccggguccaccuuccagaaggcccugcugaucagcccccaucgguucggcgagaccaaggggaacuccgcgccccucaucauccgcgagccguucaucgccugcggccccaaggagugcaagcacuucgcccugacgcauuacgccgcgcagcccggccgguacuacaacgggacccgcgaggaccggaacaagcugcgccaucucaucucggugaagcugggcaagauccccaccguggagaacuccaucuuccacauggccgccuggagcggguccgccugccacgauggccgggaguggaccuacaucggggucgacggcccggacagcaacgcccugcucaagaucaaguacggcgaggcguauacggacaccuaccacuccuacgccaagaacauccugcgcacccaggagagcgccugcaauugcaucgggggcgacugcuaccugaugaucaccgacgggcccgccucgggcaucuccgagugucgguuccucaagauccgcgagggccggaucaucaaggagaucuuccccacggggcgcgugaagcacaccgaggagugcacgugcggcuucgccagcaauaagaccaucgagugcgcgugccgggacaacuccuacaccgccaagcgccccuucgugaagcugaaugucgagaccgacaccgccgagauccggcugaugugcaccgagacguaccucgacaccccgcgccccaacgacgggagcaucaccggccccugugaguccaacggggacaagggcagcggcgggaucaagggcggguucgugcaccagcggauggccuccaagaucggccgcugguacagucggaccauguccaagacgaagcgcauggggaugggccuguacgugaaguacgacggcgaccccuggaccgacagcgaggcccuggcgcucuccggggucauggugagcauggaggagccgggcugguauuccuucggguucgagaucaaggacaagaagugcgacgugcccugcaucggcaucgagaugguccaugacgggggcaagaccaccuggcacagcgccgccacggccaucuacugccugaugggcuccgggcagcugcucugggacaccgugaccggcguggacauggcccuguga

SEQ ID NO: 29789 - RNA, 1401 nt, Artificial Sequence; identical to SEQ ID NO: 29242
  derived and/or modified CDS sequence (AUadapt) from InfluenzaB__AGX22429__NA

SEQ ID NO: 29790 - RNA, 1401 nt, Artificial Sequence; identical to SEQ ID NO: 29242
  derived and/or modified CDS sequence (AUadapt) from InfluenzaB__AGX22440__NA

SEQ ID NO: 29791 - RNA, 1401 nt, Artificial Sequence; identical to SEQ ID NO: 29242
  derived and/or modified CDS sequence (AUadapt) from InfluenzaB__AGX22449__NA

SEQ ID NO: 29792 - RNA, 1401 nt, Artificial Sequence
  derived and/or modified CDS sequence (AUadapt) from InfluenzaB__AGX22460__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgacgaugccccuggacugugcgaacgccagcaacgugcaggccgugaaccgcuccgccaccaagggcgucacccuccugcugcccgagcucgaguggaccuacccccggcugaguugcccgggguccacguuccagaaggcccugcucaucagcccccaccgcuuuggcgagaccaaggggaacuccgcgccccugaucauccgggagcccuucaucgccugcggcccgaaggagugcaagcacuuugcccugacccacuacgccgcgcagcccggcggguacuacaacggcacccgcgaggaucggaacaagcuccgccaccugaucagcgugaagcuggggaagauccccacgguggagaacuccaucuuucacauggccgccuggagcggcuccgccugccacgacgggcgggaguggaccuaugucggcguggacggccccgacucgaacgcccuccugaagaucaaguacggggaggcguauaccgacaccuaccacuccuacgccaagaauauccugcgcacgcaggagagcgccugcaacugcaucggcggggacuguuaccucaugaucaccgacggcccggccagcggcaucuccgagugccgguuccugaagauccgcgaggggcggaucaucaaggagaucuuucccaccggccgcgugaagcacaccgaggagugcacgugcggguucgccaguaacaagaccaucgagugcgcgugccgggacaacuccuauaccgccaagcgccccuucgucaagcuggacguggagaccgacacggccgagauccggcucaugugcaccgagaccuaccuggauacgccccgcccgaacgacggcagcaucaccgggcccugcgaggccaauggcgacaagggcuccgggggcaucaagggcggguucgugcaccagcggauggccagcaagaucgggcgcugguacucccggaccaugaguaagaccaagcgcaugggcaugggccuguacgucaaguacgacggggaccccuggaccgacuccgaggcgcucgcccugaguggcgugaugguguccauggaggagcccgggugguacagcuucggcuucgagaucaaggauaagaagugcgacgucccgugcaucgggaucgagauggugcacgacggcggcaagacgaccuggcauuccgccgccaccgccaucuacugccugauggggagcggccagcuccugugggacaccgugacgggggucgacauggcgcuguga

SEQ ID NO: 29793 - RNA, 1401 nt, Artificial Sequence; identical to SEQ ID NO: 28856
  derived and/or modified CDS sequence (AUadapt) from InfluenzaB__AGX22471__NA

SEQ ID NO: 29794 - RNA, 1401 nt, Artificial Sequence; identical to SEQ ID NO: 28856
  derived and/or modified CDS sequence (AUadapt) from InfluenzaB__AGX22482__NA

SEQ ID NO: 29795 - RNA, 1401 nt, Artificial Sequence; identical to SEQ ID NO: 28856
  derived and/or modified CDS sequence (AUadapt) from InfluenzaB__AGX22493__NA

SEQ ID NO: 29796 - RNA, 1401 nt, Artificial Sequence
  derived and/or modified CDS sequence (AUadapt) from InfluenzaB__AGX22504__NA
augcugcccaguaccauccagacccucacgcuguuccugaccuccggcggggugcuccugagccuguacgucuccgccucgcucuccuaccugcuguacagcgauauccuccugaaguucuccaccaccgagaucacggccccgaccaucccccuggacugcgcgaacgccagcaacgugcaggccgugaaccgcuccgccaccaagggcgucacccuccugcugcccgagcccgaguggacguauccgcggcucucgugccccggguccaccuuccagaaggcccugcugaucagcccccaccgcuucggcgagaccaaggggaacuccgcgccccucaucauccgggagccguuuaucgccugcggccccaaggagugcaagcacuucgcccugacccacuacgccgcgcagcccggcggguacuauaacggcacgcgcgaggaccggaacaagcugcgccaccucaucucggugaagcuggggaagauccccaccguggagaacuccaucuuccauauggccgccuggagcggcuccgccugccacgacgggaaggaguggaccuacaucggcgucgacggcccggacaguaacgcccugcucaagaucaaguacggggaggcguacaccgacacguaccacuccuacgccaauaacauccugcggacccaggagucggccugcaacugcaucggcgggaacugcuaccugaugaucaccgauggcagcgccuccggcaucucggagugccgcuuccucaagauccgggaggggcgcaucaucaaggagaucuuccccaccggccgggugaagcacacggaggagugcacguguggguucgccuccaacaagaccaucgagugcgcgugccgcgacaacagcuauaccgccaagcggcccuucgugaagcugaacgucgagaccgacaccgccgagauccgccugaugugcaccgagaccuaccucgacacgccccggccggacgauggcuccaucaccgggcccugcgagagcaacggcaacaagggcuccgggggcaucaagggcggguucgugcaccagcgcauggccucgaagaucgggcggugguauucccgcaccaugagcaagaccaagcggaugggcaugggccuguacgugaaguacgacggggaccccuggacggacuccgacgcccuggcgcucaguggcgucaugguguccauggaggagcccgggugguacagcuucggcuucgagaucaaggacaagaagugcgacgugccguguaucgggaucgagaugguccacgacggcggcaaggagaccuggcacuccgccgccaccgccaucuacugccugauggggagcggccagcugcucugggacaccgugacggggguggacauggcccuguga

SEQ ID NO: 29797 - RNA, 1401 nt, Artificial Sequence; identical to SEQ ID NO: 29242
  derived and/or modified CDS sequence (AUadapt) from InfluenzaB__AGX22515__NA

SEQ ID NO: 29798 - RNA, 1401 nt, Artificial Sequence
  derived and/or modified CDS sequence (AUadapt) from InfluenzaB__AGX22526__NA
augcugcccaguaccauccagacccucacgcuguuccugaccuccggcggggugcuccugagccuguacgucuccgccagccucuccuaccugcuguauucggacauccuccagaaguucucccagaccgagaucaccgccccgaucaugccccuggacugcgcgaacgccaguaacgugcaggccgugaaccgcuccgccacgaagggcgucacccugcuccugcccgagcccgaguggaccuacccgcggcugagcugccccggguccaccuuucagaaggcccuccugaucagcccccaccgcuucggcgagacgaaggggaacuccgcgccccugaucauccgggagccguucaucgccugcggccccaccgaguguaagcacuucgcccucacccacuacgccgcgcagcccggcggguacuacaauggcacccgcgaggaccggaacaagcugcgccaccugaucucggugaagcucgggaagauccccacgguggagaacuccaucuuucacauggccgccuggagcggcuccgccugccacgacgggaaggaguggaccuacaucggcgucgauggcccggacagcaacgcccugcugaagaucaaguacggggaggcguacaccgauaccuaccacuccuacgccaagaacauccuccggacgcaggagagcgccugcaauugcaucggcggggacugcuaccugaugaucaccgacggccccgccucgggcaucuccgagugucgcuuccugaagauccgggaggggcgcaucaucaaggagaucuuccccaccggccgggugaagcacaccgaggagugcacgugcggguuugccagcaacaagaccaucgagugcgcgugccgcgacaacuccuauaccgccaagcggcccuucgugaagcucaacgucgagaccgacacggccgagauccgccugaugugcaccgagaccuaccuggauaccccgcggcccaacgacggcagcaucacggggcccugcgaguccgacggcgacaagggcagugggggcaucaagggcggguucgugcaccagcgcauggccuccaagaucgggcggugguacucgcgcaccauguccaagaccaagcggaugggcaugggccucuacgugaaguacgauggggaccccuggaccgacagcgaggcccuggcgcuguccggcgucauggugagcauggaggagccggggugguacuccuuuggcuucgagaucaaggacaagaagugcgacgugcccugcaucgggaucgagaugguccacgauggcggcaagacgaccuggcacagcgccgccaccgccaucuacugccucaugggguccggccagcugcugugggacaccgugacggggguggacauggcccucuga

SEQ ID NO: 29799 - RNA, 1401 nt, Artificial Sequence; identical to SEQ ID NO: 28901
  derived and/or modified CDS sequence (AUadapt) from InfluenzaB__AGX22548__NA

SEQ ID NO: 29800 - RNA, 1401 nt, Artificial Sequence; identical to SEQ ID NO: 28740
  derived and/or modified CDS sequence (AUadapt) from InfluenzaB__AGX22559__NA

SEQ ID NO: 29801 - RNA, 1401 nt, Artificial Sequence; identical to SEQ ID NO: 28901
  derived and/or modified CDS sequence (AUadapt) from InfluenzaB__AGX22570__NA

SEQ ID NO: 29802 - RNA, 1401 nt, Artificial Sequence
  derived and/or modified CDS sequence (AUadapt) from InfluenzaB__AGX22581__NA
augcugcccaguaccauccagacccucacgcuguuccugaccuccggcggggugcuccugagccuguacgucuccgccucgcucuccuaccugcuguacagugacauccuccugaaguucucccagaccgagaucaccgccccgaucaugccccuggacugcgcgaacgccagcaacgugcaggccgugaaucgcuccgccacgaagggcgucacccuccugcugcccgagcccgaguggaccuacccgcggcucucgugccccggguccaccuuccagaaggcccugcugaucagcccccaccgcuuuggcgagacgaaggggaacuccgcgccccucaucauccgggagccguucaucgccugcggccccaaggagugcaagcacuucgcccugacccacuaugccgcgcagcccggcggguacuacaacggcacccgcgaggaccggaacaagcugcgccaccucaucagugugaagcuggggaagauccccaccguggagaacuccaucuuccacauggccgccuggagcggcuccgccugccacgacgggcgggaguggacguauaucggcgucgacggcccggacaacaacgcccugcucaagaucaaguacggggaggcguacaccgauaccuaccacagcuacgccaagaacauccugcgcacccaggaguccgccugcaacuguaucggcggggacugcuaccugaugaucacggacggccccgccucgggcaucagcgagugucgguuccucaagauccgcgaggggcggaucaucaaggagaucuuccccaccggccgcgugaagcacaccgaggagugcacgugcggguucgccuccaacaagaccaucgagugugcgugccgggacaacaacuacaccgccaagcgccccuucgugaagcugaaugucgagaccgacaccgccgagauccggcugaugugcacggagaccuaccucgacaccccgcgccccaacgacggcucgaucaccgggcccugugaguccaacggcgacaagggcagcgggggcaucaagggcggguucgugcaccagcggauggccuccaagaucgggcgcugguacagucggacgauguccaagaccaagcgcaugggcaugggccuguacgugaaguacgacggggaccccuggaccgacucggaggcccuggcgcucuccggcgucauggugagcauggaggagccggggugguauuccuucggcuucgagaucaaggacaagaagugcgacgugcccugcaucgggaucgagaugguccaugacggcggcaagaccacguggcacagcgccgccaccgccaucuacugccugaugggguccggccagcugcucugggacaccgugaccgggguggacauggcccuguga

SEQ ID NO: 29803 - RNA, 1401 nt, Artificial Sequence; identical to SEQ ID NO: 28901
  derived and/or modified CDS sequence (AUadapt) from InfluenzaB__AGX22592__NA

SEQ ID NO: 29804 - RNA, 1401 nt, Artificial Sequence; identical to SEQ ID NO: 28901
  derived and/or modified CDS sequence (AUadapt) from InfluenzaB__AGX22603__NA

SEQ ID NO: 29805 - RNA, 1401 nt, Artificial Sequence; identical to SEQ ID NO: 29141
  derived and/or modified CDS sequence (AUadapt) from InfluenzaB__AGX22614__NA

SEQ ID NO: 29806 - RNA, 1401 nt, Artificial Sequence; identical to SEQ ID NO: 28901
  derived and/or modified CDS sequence (AUadapt) from InfluenzaB__AGX22625__NA

SEQ ID NO: 29807 - RNA, 1401 nt, Artificial Sequence
  derived and/or modified CDS sequence (AUadapt) from InfluenzaB__AGX22636__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgaucaugccccuggacugugcgaacgccagcaacgugcaggccgugaaccgcuccgccgccaagggcgucgcgcuccugcugcccgagcccgaguggacguacccgcggcucaguugccccggguccaccuuccagaaggcccugcugaucagcccccaccgcuucggcgagaccaaggggaauuccgcgccccucaucauccgggagccguucaucgccugcggccccaccgagugcaagcacuucgcccugacgcauuacgccgcccagcccggcggguacuacaacggcacccgcgaggaccggaauaagcugcgccaccucaucagcgugaagcuggggaagauccccaccguggagaacuccaucuuccacauggccgccuggaguggcuccgcgugccacgacgggaaggaguggaccuacaucggcgucgacggcccggauucgaacgcccugcucaagaucaaguacggggaggccuacacggacaccuaucacuccuacgccaagaacauccugcggacccaggagagcgccugcaauugcaucggcggggacugcuaccugaugaucaccgacggccccgcgaguggcaucuccgagugccgcuuccucaagauccgggaggggcgcaucaucaaggagaucuuccccacgggccgggugaagcacaccgaggagugcacguguggguucgccagcaacaagaccaucgagugcgccugccgcgauaacuccuacaccgccaagcggcccuucgugaagcugaacgucgagaccgacaccgccgagauccgccugauguguaccgagacguaccucgacaccccgcggcccaacgacggcagcaucaccgggcccugugaguccgacggcgacaagggcagcgggggcaucaagggcggguucgugcaccagcgcauggcguccaagaucgggcggugguauagccgcaccauguccaagacgaagcggaugggcaugggccuguacgugaaguacgacggggaccccuggaccgauagcgaggcccuggcccucuccggcgucauggugagcauggaggagccggggugguacuccuucggcuucgagaucaaggauaagaagugcgacgugcccugcaucgggaucgagaugguccacgacggcggcaagaccaccuggcauagcgccgccacggcgaucuacugccugaugggguccggccagcugcucugggacaccgugaccgggguggacauggcccuguga

SEQ ID NO: 29808 - RNA, 1401 nt, Artificial Sequence; identical to SEQ ID NO: 28901
  derived and/or modified CDS sequence (AUadapt) from InfluenzaB__AGX22647__NA

SEQ ID NO: 29809 - RNA, 1401 nt, Artificial Sequence; identical to SEQ ID NO: 28740
  derived and/or modified CDS sequence (AUadapt) from InfluenzaB__AGX22658__NA

SEQ ID NO: 29810 - RNA, 1401 nt, Artificial Sequence; identical to SEQ ID NO: 28901
  derived and/or modified CDS sequence (AUadapt) from InfluenzaB__AGX22669__NA

SEQ ID NO: 29811 - RNA, 1401 nt, Artificial Sequence; identical to SEQ ID NO: 28901
  derived and/or modified CDS sequence (AUadapt) from InfluenzaB__AGX22680__NA

SEQ ID NO: 29812 - RNA, 1401 nt, Artificial Sequence; identical to SEQ ID NO: 28901
  derived and/or modified CDS sequence (AUadapt) from InfluenzaB__AGX22691__NA

SEQ ID NO: 29813 - RNA, 1401 nt, Artificial Sequence; identical to SEQ ID NO: 28901
  derived and/or modified CDS sequence (AUadapt) from InfluenzaB__AGX22702__NA

SEQ ID NO: 29814 - RNA, 1401 nt, Artificial Sequence; identical to SEQ ID NO: 28901
  derived and/or modified CDS sequence (AUadapt) from InfluenzaB__AGX22713__NA

SEQ ID NO: 29815 - RNA, 1401 nt, Artificial Sequence
  derived and/or modified CDS sequence (AUadapt) from InfluenzaB__AGX22724__NA
augcugcccaguaccauccagacccucacgcuguuccugaccuccggcggggugcuccugagccuguacgucuccgcccuccugagcuaccugcucuauuccgacauccugcugaaguucagccagaccgagaucaccgccccgaucaugccccucgacugcgcgaacgccuccaaugugcaggccgugaaccgcucggccacgaagggcgucacccugcugcuccccgagcccgaguggaccuacccgcggcuguccugccccgggagcaccuuucagaaggcccugcucaucagcccccaccgcuucggcgagacgaaggggaacuccgcgccccugaucauccgggagccguucaucgccugcggccccaaggaguguaagcacuucgcccugacccacuacgccgcgcagcccggcggguacuacaauggcacccgcgaggaccggaacaagcuccgccaccugaucuccgugaagcuggggaagauccccaccguggagaacagcaucuuucacauggccgccugguccggcagcgccugccacgacgggcgggaguggacguacaucggcgucgauggcccggacuccaacgcccuccugaagaucaaguacggggaggcguacaccgacaccuaucacucguacgccaagaacauccugcgcacccaggaguccgccugcaacuguaucggcggggacugcuaccucaugaucacggacggccccgccagcggcaucagcgagugucgguuccugaagauccgcgaggggcggaucaucaaggagaucuuccccaccggccgcgugaagcacaccgaggagugcacgugcggguuugccuccaacaagaccaucgagugcgcgugccgggacaacagcuauaccgccaagcgccccuucgugaagcugaacgucgagaccgacaccgccgagauccggcucaugugcacggagaccuaccuggauaccccgcgccccaacgacggcuccaucaccgggcccugcgagagcaacggcgacaagggcuccgggggcaucaagggcggguuugugcaccagcggauggccucgaagaucgggcgcugguacucccggacgaugagcaagaccaagcgcaugggcaugggccuguacgugaaguacgauggggaccccuggaccgacuccgaggcccucgcgcugagcggcgucaugguguccauggaggagccggggugguacagcuuuggcuucgagaucaaggacaagaagugcgacgugcccugcaucgggaucgagaugguccacgauggcggcaagaccacguggcacuccgccgccaccgccaucuacugccugauggggagcggccagcuccugugggacaccgugaccgggguggacauggcccuguga

SEQ ID NO: 29816 - RNA, 1401 nt, Artificial Sequence; identical to SEQ ID NO: 28901
  derived and/or modified CDS sequence (AUadapt) from InfluenzaB__AGX22735__NA

SEQ ID NO: 29817 - RNA, 1401 nt, Artificial Sequence
  derived and/or modified CDS sequence (AUadapt) from InfluenzaB__AGX22746__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaacgccaguaacgugcaggccgugaaccgcuccgccacgaagggcgucacccuccugcugcccgagcccgaguggaccuacccgcggcucagcugccccggguccaccuuucagaaggcccugcugaucagcccccaccgcuucggcgagacgaaggggaacuccgcgccccucaucauccgggagccguucaucgccugcggccccaccgaguguaagcacuucgcccugacccacuacgccgcgcagcccggcggguacuacaaucgcacccgggaggaccgcaacaagcugcggcaccucaucagcgugaagcugggcaagauccccacgguggagaacuccaucuuucacauggccgccuggagcggguccgccugccacgacggcaaggaguggaccuacaucggggucgauggcccggacucgaacgcccugcucaagaucaaguacggcgaggcguacaccgauaccuaccacuccuacgccaagaacauccugcgcacgcaggagagcgccugcaauugcaucgggggcgacugcuaccugaugaucaccgacgggcccgccagcggcaucuccgagugucgguuccucaagauccgcgagggccggaucaucaaggagaucuuccccaccgggcgcgugaagcacaccgaggagugcacgugcggcuuugccagcaacaagaccaucgagugcgcgugccgggacaacuccuauaccgccaagcgccccuucgugaagcugaacgucgagaccgacacggccgagauccggcugaugugcaccgagaccuaccucgauaccccgcgccccaacgacgggagcaucacgggccccugcgaguccgacggggacaagggcaguggcgggaucaagggcggguucgugcaccagcggauggccuccaagaucggccgcugguacagccggaccauguccaagaccaagcgcauggggaugggccuguacgugaaguacgauggcgaccccuggaccgacagcgaggcccuggcgcucuccggggucauggugagcauggaggagccgggcugguacuccuuuggguucgagaucaaggacaagaagugcgacgugcccugcaucggcaucgagaugguccacgaugggggcaagacgaccuggcacagcgccgccaccgccaucuacugccugaugggcuccgggcagcugcucugggacaccgugacgggcguggacauggcccuguga

SEQ ID NO: 29818 - RNA, 1401 nt, Artificial Sequence; identical to SEQ ID NO: 28901
  derived and/or modified CDS sequence (AUadapt) from InfluenzaB__AGX22757__NA

SEQ ID NO: 29819 - RNA, 1401 nt, Artificial Sequence; identical to SEQ ID NO: 28901
  derived and/or modified CDS sequence (AUadapt) from InfluenzaB__AGX22768__NA

SEQ ID NO: 29820 - RNA, 1401 nt, Artificial Sequence; identical to SEQ ID NO: 29242
  derived and/or modified CDS sequence (AUadapt) from InfluenzaB__AGX22779__NA

SEQ ID NO: 29821 - RNA, 1401 nt, Artificial Sequence; identical to SEQ ID NO: 28901
  derived and/or modified CDS sequence (AUadapt) from InfluenzaB__AGX22790__NA

SEQ ID NO: 29822 - RNA, 1401 nt, Artificial Sequence
  derived and/or modified CDS sequence (AUadapt) from InfluenzaB__AGX22801__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaaugccagcaacgugcaggccgugaaccgcuccgccgccaagggcgucacgcuccugcugcccgagcccgaguggaccuacccgcggcucagcugucccggguccaccuuccagaaggcgcugcugaucucgccccaccgcuucggcgagaccaaggggaacuccgcgccccucaucauccgggagccguucaucgccuguggccccacggagugcaagcacuucgcccugacccacuacgccgcccagcccggcggguauuacaacggcacccgcggggaccggaacaagcugcgccaccucaucagugugaagcugggcaagauccccaccguggagaacuccaucuuccacauggccgccuggagcggguccgccugccacgauggcaaggaguggacguacaucggcgucgacgggccggacagcaacgcgcugcucaagaucaaguauggcgaggccuacaccgacaccuaccacuccuacgccaagaauauccugcggacccaggagagcgccugcaacugcaucgggggcaacugcuaucugaugaucacggacggcagcgccuccggggugagcgagugccgcuuccucaagauccgggagggccgcaucaucaaggagaucuuucccaccgggcgggugaagcacaccgaggagugcacgugcggcuucgcguccaacaagaccaucgagugugccugccgcgacaacucguacaccgccaagcggcccuucgucaagcugaauguggagaccgacaccgccgagauccgccugaugugcacggagaccuaccucgacacgccccggccgaacgauggguccaucaccggccccugcgagagcgacggcgacaagggguccggcgggaucaagggcggguucgugcaucagcgcauggccagcaagaucggccggugguacucccgcaccaugagcaagaccaagcggaugggcauggggcuguacgucaaguacgacggcgaucccuggaccgacuccgaggcgcuggcccucagcggggugaugguguccauggaggagcccggcugguacagcuucggguuugagaucaaggacaagaagugcgacgucccgugcaucggcaucgagauggugcacgauggcgggaagaccacguggcacuccgccgccaccgccaucuacugccugaugggcagcgggcagcugcucugggacaccgugaccggcgucgacauggcgcuguga

SEQ ID NO: 29823 - RNA, 1401 nt, Artificial Sequence; identical to SEQ ID NO: 28901
  derived and/or modified CDS sequence (AUadapt) from InfluenzaB__AGX22812__NA

SEQ ID NO: 29824 - RNA, 1401 nt, Artificial Sequence; identical to SEQ ID NO: 28901
  derived and/or modified CDS sequence (AUadapt) from InfluenzaB__AGX22823__NA

SEQ ID NO: 29825 - RNA, 1401 nt, Artificial Sequence; identical to SEQ ID NO: 28901
  derived and/or modified CDS sequence (AUadapt) from InfluenzaB__AGX22834__NA

SEQ ID NO: 29826 - RNA, 1401 nt, Artificial Sequence; identical to SEQ ID NO: 28901
  derived and/or modified CDS sequence (AUadapt) from InfluenzaB__AGX22845__NA

SEQ ID NO: 29827 - RNA, 1401 nt, Artificial Sequence; identical to SEQ ID NO: 28901
  derived and/or modified CDS sequence (AUadapt) from InfluenzaB__AGX22856__NA

SEQ ID NO: 29828 - RNA, 1401 nt, Artificial Sequence; identical to SEQ ID NO: 28901
  derived and/or modified CDS sequence (AUadapt) from InfluenzaB__AGX22867__NA

SEQ ID NO: 29829 - RNA, 1401 nt, Artificial Sequence; identical to SEQ ID NO: 28901
  derived and/or modified CDS sequence (AUadapt) from InfluenzaB__AGX22878__NA

SEQ ID NO: 29830 - RNA, 1401 nt, Artificial Sequence
  derived and/or modified CDS sequence (AUadapt) from InfluenzaB__AGX22889__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgaucaugccccuggacugugcgaacgccagcaacgugcaggccgugaaccgcuccgccgccaagggcgucacgcuccugcugcccgagcccgaguggaccuacccgcggcucaguugccccggguccaccuuccagaaggcgcugcugaucucgccccaccgcuucggcgagaccaaggggaauuccgcgccccucaucauccgggagccguucaucgccugcggccccacggagugcaagcacuucgcccugacccauuacgccgcccagcccggcggguacuacaacggcacccgcgaggaccggaauaagcugcgccaccucaucagcgugaagcuggggaagauccccaccguggagaacuccaucuuccacauggccgccuggaguggcuccgccugccacgacgggaaggaguggacguacaucggcgucgacggcccggauagcaacgcgcugcucaagaucaaguacggggaggccuacaccgacaccuaucacuccuacgccaagaacauccugcggacccaggagagcgccugcaauugcaucggcggggacugcuaccugaugaucacggacggccccgccaguggcaucuccgagugccgcuuccucaagauccgggaggggcgcaucaucaaggagaucuuccccaccggccgggugaagcacaccgaggagugcacguguggguucgcgucgaacaagaccaucgagugcgccugccgcgauaacucccacaccgccaagcggcccuucgugaagcugaacgucgagaccgacaccgccgagauccgccugauguguacggagaccuaccucgacaccccgcggcccaacgacggcagcaucaccgggcccugugaguccgacggcgacaagggcagcgggggcaucaagggcggguucgugcaccagcgcauggccuccaagaucgggcggugguauagccgcacgauguccaagaccaagcggaugggcaugggccuguacgugaaguacgacggggaccccuggaccgauagcgaggcgcuggcccucuccggcgucauggugagcauggaggagccggggugguacuccuucggcuucgagaucaaggauaagaagugcgacgugcccugcaucgggaucgagaugguccacgacggcggcaagaccacguggcauagcgccgccaccgccaucuacugccugaugggguccggccagcugcucugggacaccgugaccgggguggacauggcgcuguga

SEQ ID NO: 29831 - RNA, 1401 nt, Artificial Sequence; identical to SEQ ID NO: 28740
  derived and/or modified CDS sequence (AUadapt) from InfluenzaB__AGX22900__NA

SEQ ID NO: 29832 - RNA, 1401 nt, Artificial Sequence
  derived and/or modified CDS sequence (AUadapt) from InfluenzaB__AGX22911__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgaucaugccccuggacugugcgaacgccagcaacgugcaggccgugaaccgcuccgccgccaagggcgucacgcuccugcugcccgagcccgaguggaccuacccgcggcucaguugccccggguccaccuuccagaaggcgcugcugaucucgccccaccgcuucggcgagaccaaggggaauuccgcgccccucaucauccgggagccguucaucgccugcggccccacggagugcaagcacuucgcccugacccauuacgccgcccagcccggcggguacuacaacggcacccgcgaggaccggaauaagcugcgccaccucaucagcgugaagcuggggaagauccccaccguggagaacuccaucuuccacauggccgccuggaguggcuccgccugccacgacgggaaggaguggacguacaucggcgucgacggcccggauagcaacgcgcugcucaagaucaaguacggggaggccuacaccgacaccuaucacuccuacgccaagaacauccugcggacccaggagagcgccugcaauugcaucggcggggacugcuaccugaugaucacggacggccccgccaguggcaccuccgagugccgcuuccucaagauccgggaggggcgcaucaucaaggagaucuuccccaccggccgggugaagcacaccgaggagugcacguguggguucgcgucgaacaagaccaucgagugcgccugccgcgauaacuccuacaccgccaagcggcccuucgugaagcugaacgucgagaccgacacggccgagauccgccugauguguaccgagaccuaccucgacaccccgcggcccaacgacggcagcaucacggggcccugugaguccgacggcgacaagggcagcgggggcaucaagggcggguucgugcaccagcgcauggccuccaagaucgggcggugguauagccgcaccauguccaagaccaagcggaugggcaugggccuguacgugaaguacgacggggaccccuggaccgauagcgaggcgcuggcccucuccggcgucauggugagcauggaggagccggggugguacuccuucggcuucgagaucaaggauaagaagugcgacgugcccugcaucgggaucgagaugguccacgacggcggcaagacgaccuggcauagcgccgccaccgccaucuacugccugaugggguccggccagcugcucugggacaccgugacggggguggacauggcgcuguga

SEQ ID NO: 29833 - RNA, 1401 nt, Artificial Sequence
  derived and/or modified CDS sequence (AUadapt) from InfluenzaB__AGX22922__NA
augcugcccaguaccauccagacccucacgcuguuccugaccuccggcggggugcuccugagccuguacgucuccgccagccucuccuaccugcuguacagugacauccuccugaaguucucccagaccgagaucaccgccccgaucaugccccuggacugcgcgaacgccagcaaugugcaggccgugaaccgcuccgccacgaagggcgucacccuccugcugcccgagcccgaguggaccuacccgcggcucagcugccccggguccaccuuccagaaggcccugcugaucucgccccaucgcuucggcgagacgaaggggaacuccgcgccccucaucauccgggagccguucaucgccugcggccccaccgagugcaagcacuuugcccugacccacuacgccgcgcagcccggcggguacuacaacggcacccgcgaggaccggaauaagcugcgccaccucaucagcgugaagcuggggaagauccccacgguggagaacuccaucuuccacauggccgccuggagcggcuccgccugucacgacgggaaggaguggaccuacaucggcgucgacggcccggacucgaaugcccugcucaagaucaaguacggggaggcguacaccgacaccuaccacuccuacgccaagaauauccugcggacgcaggagagcgccugcaacugcaucggcggggacugcuaucugaugaucaccgacggccccgccagcggcaucuccgagugccgcuuccucaagauccgggaggggcgcaucaucaaggagaucuuccccaccggccgggugaagcacaccgaggaguguacgugcggguucgccucgaacaagaccaucgagugcgcgugccgcgauaacuccuacaccgccaagcggcccuucgugaagcugaacgucgagaccgacacggccgagauccgccugaugugcaccgagaccuaucucgacaccccgcggcccaacgacggcagcaucacggggcccugcgaguccgacggcgauaagggcagcgggggcaucaagggcggguucgugcaccagcgcauggccuccaagaucgggcggugguacucgcgcaccauguccaagaccaagcggaugggcaugggccuguacgugaaguaugacggggaccccuggaccgacaacgaggcccuggcgcucagcggcgucaugguguccauggaggagccggggugguacaguuucggcuucgagaucaaggacaagaagugcgacgugcccugcaucgggaucgagaugguccaugacggcggcaagacgaccuggcacuccgccgccaccgccaucuacugccugauggggagcggccagcugcucugggacaccgugacggggguggacauggcccuguga

SEQ ID NO: 29834 - RNA, 1401 nt, Artificial Sequence; identical to SEQ ID NO: 28901
  derived and/or modified CDS sequence (AUadapt) from InfluenzaB__AGX22933__NA

SEQ ID NO: 29835 - RNA, 1401 nt, Artificial Sequence; identical to SEQ ID NO: 28901
  derived and/or modified CDS sequence (AUadapt) from InfluenzaB__AGX22944__NA

SEQ ID NO: 29836 - RNA, 1401 nt, Artificial Sequence; identical to SEQ ID NO: 28901
  derived and/or modified CDS sequence (AUadapt) from InfluenzaB__AGX22955__NA

SEQ ID NO: 29837 - RNA, 1401 nt, Artificial Sequence; identical to SEQ ID NO: 28901
  derived and/or modified CDS sequence (AUadapt) from InfluenzaB__AGX22966__NA

SEQ ID NO: 29838 - RNA, 1401 nt, Artificial Sequence; identical to SEQ ID NO: 28740
  derived and/or modified CDS sequence (AUadapt) from InfluenzaB__AGX22977__NA

SEQ ID NO: 29839 - RNA, 1401 nt, Artificial Sequence; identical to SEQ ID NO: 29156
  derived and/or modified CDS sequence (AUadapt) from InfluenzaB__AGX22988__NA

SEQ ID NO: 29840 - RNA, 1401 nt, Artificial Sequence
  derived and/or modified CDS sequence (AUadapt) from InfluenzaB__AGX22999__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgaucaugccccuggacugugcgaacgccagcaacgugcaggccgugaaccgcuccgccgccaagggcgucacgcuccugcugcccgagcccgagugggcguacccgcggcucaguugccccggguccaccuuccagaaggcccugcugaucagcccccaccgcuucggcgagaccaaggggaauuccgcgccccucaucauccgggagccguucaucgccugcggccccaccgagugcaagcacuucgcccugacgcauuacgccgcccagcccggcggguacuacaacggcacccgcgaggaccggaauaagcugcgccaccucaucagcgugaagcuggggaagauccccaccguggagaacuccaucuuccacauggccgccuggaguggcuccgcgugccacgacgggaaggaguggaccuacaucggcgucgacggcccggauucgaacgcccugcucaagaucaaguacggggaggccuacacggacaccuaucacuccuacgccaagaacauccugcggacccaggagagcgccugcaauugcaucggcggggacugcuaccugaugaucaccgacggccccgcgaguggcaucuccgagugccgcuuccucaagauccgggaggggcgcaucaucaaggagaucuuccccacgggccgggugaagcacaccgaggagugcacguguggguucgccagcaacaagaccaucgagugcgccugccgcgauaacuccuacaccgccaagcggcccuucgugaagcugaacgucgagaccgacaccgccgagauccgccugauguguaccgagacguaccucgacaccccgcggcccaacgacggcagcaucaccgggcccugugaguccgacggcgacaagggcagcgggggcaucaagggcggguucgugcaccagcgcauggcguccaagaucgggcggugguauagccgcaccauguccaagacgaagcggaugggcaugggccuguacgugaaguacgacggggaccccuggaccgauagcgaggcccuggcccucuccggcgucauggugagcauggaggagccggggugguacuccuucggcuucgagaucaaggauaagaagugcgacgugcccugcaucgggaucgagaugguccacgacggcggcaagaccaccuggcauagcgccgccacggcgaucuacugccugaugggguccggccagcugcucugggacaccgugaccgggguggacauggcccuguga

SEQ ID NO: 29841 - RNA, 1401 nt, Artificial Sequence; identical to SEQ ID NO: 29840
  derived and/or modified CDS sequence (AUadapt) from InfluenzaB__AGX23010__NA

SEQ ID NO: 29842 - RNA, 1401 nt, Artificial Sequence; identical to SEQ ID NO: 28740
  derived and/or modified CDS sequence (AUadapt) from InfluenzaB__AGX23021__NA

SEQ ID NO: 29843 - RNA, 1401 nt, Artificial Sequence; identical to SEQ ID NO: 28901
  derived and/or modified CDS sequence (AUadapt) from InfluenzaB__AGX23032__NA

SEQ ID NO: 29844 - RNA, 1401 nt, Artificial Sequence
  derived and/or modified CDS sequence (AUadapt) from InfluenzaB__AGX23043__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaaugccagcaacgugcaggccgugaaccgcuccgccgccaagggcgucacgcuccugcugcccgagcccgaguggaccuacccgcggcucagcugucccggguccaccuuccagaaggcgcugcugaucucgccccaccgcuucggcgagaccaaggggaacuccgcgccccucaucauccgggagccguucaucgccuguggccccacggagugcaagcacuucgcccugacccacuacgccgcccagcccggcggguauuacaacggcacccgcgaggaccggaacaagcugcgccaccucaucagugugaagcuggggaagauccccaccguggagaacuccaucuuccacauggccgccuggagcggcuccgccugccaugacgggaaggaguggacguacaucggcgucgacggcccggacagcaacgcgcugcucaagaucaaguauggggaggccuacaccgacaccuaccacuccuacgccaagaauauccugcggacccaggagagcgccugcaacugcaucggcggggacuguuaccugaugaucacggacggccccgcccucggcaucagcgagugccgcuuccugaagauccgggaggggcgcaucaucaaggagaucuuucccaccggccgggugaagcacaccgaggagugcacgugcggguucgcguccaacaagaccaucgagugcgccugucgcgacaacucguacaccgccaagcggcccuucgugaagcugaaugucgagaccgacaccgccgagauccgccucaugugcacggagaccuaccuggacaccccgcggcccaacgauggcuccaucaccgggcccugcgagagcgacggcgacaagggcuccgggggcaucaagggcggguucgugcaucagcgcauggccagcaagaucgggcggugguacucccgcacgaugagcaagaccaagcggaugggcaugggccuguacgugaaguacgacggggaucccuggaccgacuccgaggcgcucgcccugagcggcgucaugguguccauggaggagccggggugguacagcuucggcuuugagaucaaggacaagaagugcgacgugcccugcaucgggaucgagaugguccacgauggcggcaagaccacguggcacuccgccgccaccgccaucuacugccugauggggagcggccagcuccugugggacaccgugaccgggguggacauggcgcuguga

SEQ ID NO: 29845 - RNA, 1401 nt, Artificial Sequence; identical to SEQ ID NO: 28740
  derived and/or modified CDS sequence (AUadapt) from InfluenzaB__AGX23054__NA

SEQ ID NO: 29846 - RNA, 1401 nt, Artificial Sequence; identical to SEQ ID NO: 28740
  derived and/or modified CDS sequence (AUadapt) from InfluenzaB__AGX23065__NA

SEQ ID NO: 29847 - RNA, 1401 nt, Artificial Sequence; identical to SEQ ID NO: 28740
  derived and/or modified CDS sequence (AUadapt) from InfluenzaB__AGX23076__NA

SEQ ID NO: 29848 - RNA, 1401 nt, Artificial Sequence; identical to SEQ ID NO: 28901
  derived and/or modified CDS sequence (AUadapt) from InfluenzaB__AGX23087__NA

SEQ ID NO: 29849 - RNA, 1401 nt, Artificial Sequence; identical to SEQ ID NO: 28740
  derived and/or modified CDS sequence (AUadapt) from InfluenzaB__AGX23098__NA

SEQ ID NO: 29850 - RNA, 1401 nt, Artificial Sequence
  derived and/or modified CDS sequence (AUadapt) from InfluenzaB__AGX23109__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaacgccaguaacgugcaggccgugaaccgcuccgccacgaagggcgucacccuccugcugcccgagcccgaguggaccuacccgcggcucagcugccccggguccaccuuucagaaggcccugcugaucagcccccaccgcuucggcgagacgaaggggaacuccgcgccccucaucauccgggagccguucaucgccugcggccccaccgaguguaagcacuucgcccugacccacuacgccgcgcagcccggcggguacuacaauggcacccgcgaggaccggaacaagcugcgccaccucaucagcgugaagcuggggaagauccccacgguggagaacuccaucuuucacauggccgccuggagcggcuccgccugccacgacgggaaggaguggaccuacaucggcgucgauggcccggacucgaacgcccugcucaagaucaaguacggggaggcguacaccgauaccuaccacuccuacgccaagaacauccugcggacgcaggagagcgccugcaauugcauccgcggcgacugcuaccugaugaucaccgacgggcccgccagcggcaucuccgagugucgguuccucaagauccgcgagggccggaucaucaaggagaucuuccccaccgggcgcgugaagcacaccgaggagugcacgugcggcuuugccagcaacaagaccaucgagugcgcgugccgggacaacuccuauaccgccaagcgccccuucgugaagcugaacgucgagaccgacacggccgagauccggcugaugugcaccgagaccuaccucgauaccccgcgccccaacgacgggagcaucacgggccccugcgaguccgacggggacaagggcaguggcgggaucaagggcggguucgugcaccagcggauggccuccaagaucggccgcugguacagccggaccauguccaagaccaagcgcauggggaugggccuguacgugaaguacgauggcgaccccuggaccgacagcgaggcccuggcgcucuccggggucauggugagcauggaggagccgggcugguacuccuuuggguucgagaucaaggacaagaagugcgacgugcccugcaucggcaucgagaugguccacgaugggggcaagacgaccuggcacagcgccgccaccgccaucuacugccugaugggcuccgggcagcugcucugggacaccgugacgggcguggacauggcccuguga

SEQ ID NO: 29851 - RNA, 1401 nt, Artificial Sequence; identical to SEQ ID NO: 28901
  derived and/or modified CDS sequence (AUadapt) from InfluenzaB__AGX23120__NA

SEQ ID NO: 29852 - RNA, 1401 nt, Artificial Sequence
  derived and/or modified CDS sequence (AUadapt) from InfluenzaB__AGX23131__NA
augcugcccaguaccauccagacccucacgcuguuccugaccuccggcggggugcuccugagccuguacgucuccgccagccucuccuaccugcuguauagcgacauccuccugaaguucucccagaccgagaucaucgccccgaucaugccccuggacugcgcgaacgccaguaacgugcaggccgugaaccgcuccgccgccaagggcgucacccuccugcugcccgagcccgaguggacguacccgcggcucagcugccccggguccaccuuucagaaggcgcugcugaucucgccccaccgcuucggcgagaccaaggggaacuccgcgccccucaucauccgggagccguucaucgccugcggccccaccgaguguaagcacuucgcccugacgcacuacgccgcccagcccggcggguacuacaauggcacccgcgaggaccggaacaagcugcgccaccucaucagcgugaagcuggggaagauccccaccguggagaacuccaucuuucacauggccgccuggagcggcuccgccugccacgacgggaaggaguggaccuacaucggcgucgauggcccggacagcaacgcgcugcucaagaucaaguacggggaggccuacacggauaccuaccacuccuacgccaagaacauccugcggacccaggagagcgccugcaauugcaucggcggggacugcuaccugaugaucaccgacggccccgccagcggcaucuccgagugucgcuuccucaagauccgggaggggcgcaucaucaaggagaucuuccccacgggccgggugaagcacaccgaggagugcacgugcggguuugcgucgaacaagaccaucgagugcgccugccgcgacaacuccuauaccgccaagcggcccuucgugaagcugaacgucgagaccgacaccgccgagauccgccugaugugcaccgagacguaccucgauaccccgcggcccaacgacggcagcaucaccgggcccugcgaguccgacggcgacaagggcagugggggcaucaagggcggguucgugcaccagcgcauggccuccaagaucgggcggugguacagccgcaccauguccaagacgaagcggaugggcaugggccuguacgugaaguacgauggggaccccuggaccgacagcgaggcgcuggcccucuccggcgucauggugagcauggaggagccggggugguacuccuuuggcuucgagaucaaggacaagaagugcgacgugcccugcaucgggaucgagaugguccacgauggcggcaagaccaccuggcacagcgccgccacggccaucuacugccugaugggguccggccagcugcucugggacaccgugaccgggguggacauggcgcuguga

SEQ ID NO: 29853 - RNA, 1401 nt, Artificial Sequence; identical to SEQ ID NO: 28901
  derived and/or modified CDS sequence (AUadapt) from InfluenzaB__AGX23142__NA

SEQ ID NO: 29854 - RNA, 1401 nt, Artificial Sequence; identical to SEQ ID NO: 28740
  derived and/or modified CDS sequence (AUadapt) from InfluenzaB__AGX23153__NA

SEQ ID NO: 29855 - RNA, 1401 nt, Artificial Sequence; identical to SEQ ID NO: 28740
  derived and/or modified CDS sequence (AUadapt) from InfluenzaB__AGX23164__NA

SEQ ID NO: 29856 - RNA, 1401 nt, Artificial Sequence; identical to SEQ ID NO: 28740
  derived and/or modified CDS sequence (AUadapt) from InfluenzaB__AGX23175__NA

SEQ ID NO: 29857 - RNA, 1401 nt, Artificial Sequence
  derived and/or modified CDS sequence (AUadapt) from InfluenzaB__AGX23186__NA
augcugcccaguaccacccagacgcucacccuguuccugaccuccggcggggugcuccugagccuguacgucuccgccagccucuccuaucugcuguacagcgacauccuccugaaguucucccagaccgagaucacggccccgaucaugccccuggacugugcgaacgccagcaacgugcaggccgugaaccgcuccgccgccaagggcgucacccuccugcugcccgagcccgaguggaccuacccgcggcucaguugccccggguccaccuuccagaaggcgcugcugaucucgccccaccgcuucggcgagacgaaggggaauuccgcgccccucaucauccgggagccguucaucgccugcggccccaccgagugcaagcacuucgcccugacccauuacgccgcccagcccggcggguacuacaacggcacccgcgaggaccggaauaagcugcgccaccucaucagcgugaagcuggggaagauccccacgguggagaacuccaucuuccacauggccgccuggaguggcuccgccugccacgacgggaaggaguggaccuacaucggcgucgacggcccggauagcaacgcgcugcucaagaucaaguacggggaggccuacaccgacaccuaucacuccuacgccaagaacauccugcggacgcaggagagcgccugcaauugcaucggcggggacugcuaccugaugaucaccgacggccccgccaguggcaucuccgagugccgcuuccucaagauccgggaggggcgcaucaucaaggagaucuuccccaccggccgggugaagcacaccgaggagugcacguguggguucgcgucgaacaagaccaucgagugcgccugccgcgauaacuccuacaccgccaagcggcccuucgugaagcugaacgucgagaccgacacggccgagauccgccugauguguaccgagaccuaccucgacaccccgcggcccaacgacggcagcaucacggggcccugugaguccgacggcgacaagggcagcgggggcaucaagggcggguucgugcaccagcgcauggccuccaagaucgggcggugguauagccgcaccauguccaagaccaagcggaugggcaugggccuguacgugaaguacgacggggaccccuggaccgauagcgaggcgcuggcccucuccggcgucauggugagcauggaggagccggggugguacuccuucggcuucgagaucaaggauaagaagugcgacgugcccugcaucgggaucgagaugguccacgacggcggcaagacgaccuggcauagcgccgccaccgccaucuacugccugaugggguccggccagcugcucugggacaccgugacggggguggacauggcgcuguga

SEQ ID NO: 29858 - RNA, 1401 nt, Artificial Sequence; identical to SEQ ID NO: 28901
  derived and/or modified CDS sequence (AUadapt) from InfluenzaB__AGX23197__NA

SEQ ID NO: 29859 - RNA, 1401 nt, Artificial Sequence; identical to SEQ ID NO: 28901
  derived and/or modified CDS sequence (AUadapt) from InfluenzaB__AGX23208__NA

SEQ ID NO: 29860 - RNA, 1401 nt, Artificial Sequence; identical to SEQ ID NO: 28901
  derived and/or modified CDS sequence (AUadapt) from InfluenzaB__AGX23219__NA

SEQ ID NO: 29861 - RNA, 1401 nt, Artificial Sequence
  derived and/or modified CDS sequence (AUadapt) from InfluenzaB__AGX23230__NA
augcugcccaguaccauccagacccucacgcuguuccugaccuccggcggggugcuccugagccuguacgucuccgccagccucuccuaccugcuguacagugacauccuccugaaguucucccagaccgagaucaccgccccgaucaugccccuggacugcgcgaacgccucgaaugugcaggccgugaaccgcuccgccgccaagggcgucacgcuccugcugcccgagcccgaguggaccuacccgcggcucagcugccccggguccaccuuccagaaggcgcugcugaucagcccccaucgcuucggcgagaccaaggggaacuccgcgccccucaucauccgggagccguucaucgccugcggccccacggagugcaagcacuuugcccugacccacuacgccgcccagcccggcgaguacuacaacgggacccgcgaggaccggaauaagcugcgccaccucaucagcgugaagcugggcaagauccccaccguggagaacuccaucuuccacauggccgccuggucgggguccgccugucacgacggcaaggaguggacguacaucggggucgacggcccggacagcaaugcgcugcucaagaucaaguacggcgaggccuacaccgacaccuaccacuccuacgccaagaauauccugcggacccaggagagcgccugcaacugcaucgggggcgacugcuaucugaugaucacggacgggcccagcuccggcaucucggagugccgcuuccucaagauccgggagggccgcaucaucaaggagaucuuccccaccgggcgggugaagcauaccgaggagugcacgugcggcuucgccuccaacaagaccaucgagugcgcgugccgcgauaacagcuacaccgccaagcggcccuucgugaagcugaacgucgagaccgacaccgccgagauccgccugauguguacggagaccuaccucgacaccccgcggcccaacgacggguccaucaccggccccugcgagagcgauggggacaagggcuccggcgggaucaagggcggguucgugcaccagcgcauggccagcaagaucggccggugguacucccgcacgaugucgaagaccaagcggauggggaugggccuguaugugaaguacgacggcgaccccuggaccgacuccgaggcccuggcgcucagcggggucaugguguccauggaggagccgggcugguacaguuucggguucgagaucaaggacaagaagugcgacgugcccugcaucggcaucgagaugguccaugacgggggcaagaccacguggcacuccgccgccaccgccaucuacugccugaugggcagcgggcagcugcucugggacaccgugaccggcguggacauggcccuguga

SEQ ID NO: 29862 - RNA, 1401 nt, Artificial Sequence; identical to SEQ ID NO: 28740
  derived and/or modified CDS sequence (AUadapt) from InfluenzaB__AGX23241__NA

SEQ ID NO: 29863 - RNA, 1401 nt, Artificial Sequence; identical to SEQ ID NO: 28901
  derived and/or modified CDS sequence (AUadapt) from InfluenzaB__AGX23252__NA

SEQ ID NO: 29864 - RNA, 1401 nt, Artificial Sequence; identical to SEQ ID NO: 28901
  derived and/or modified CDS sequence (AUadapt) from InfluenzaB__AGX23263__NA

SEQ ID NO: 29865 - RNA, 1401 nt, Artificial Sequence; identical to SEQ ID NO: 28901
  derived and/or modified CDS sequence (AUadapt) from InfluenzaB__AGX23274__NA

SEQ ID NO: 29866 - RNA, 1401 nt, Artificial Sequence; identical to SEQ ID NO: 28740
  derived and/or modified CDS sequence (AUadapt) from InfluenzaB__AGX23285__NA

SEQ ID NO: 29867 - RNA, 1401 nt, Artificial Sequence; identical to SEQ ID NO: 28901
  derived and/or modified CDS sequence (AUadapt) from InfluenzaB__AGX23296__NA

SEQ ID NO: 29868 - RNA, 1401 nt, Artificial Sequence
  derived and/or modified CDS sequence (AUadapt) from InfluenzaB__AGX23307__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgaucaugccccuggacugugcgaacgccagcaacgugcaggccgugaaccgcuccgccgccaagggcgucacgcuccugcugcccgagcccgaguggaccuacccgcggcucaguugccccggguccaccuuccagaaggcgcugcugaucagcccccaccgcuucggcgagaccaaggggaauuccgcgccccucaucauccgggagccguucaucgccugcggccccacggagugcaagcacuucgcccugacccauuacgccgcccagcccggcggguacuacaacggcacccgcgaggaccggaauaagcugcgccaccucaucagcgugaagcuggggaagauccccaccguggagaacuccaucuuccacauggccgccuggaguggcuccgccugccacgacgggaaggaguggacguacgucggcguggacggcccggauucgaacgcgcugcucaagaucaaguacggggaggccuacaccgacaccuaucacuccuacgccaagaacauccugcggacccaggagagcgccugcaauugcaucggcggggacugcuaccugaugaucacggacggccccgccaguggcaucuccgagugccgcuuccucaagauccgggaggggcgcaucaucaaggagaucuuccccaccggccgggugaagcacaccgaggagugcacguguggguucgcgagcaacaagaccaucgagugcgccugccgcgauaacuccuacaccgccaagcggcccuucgucaagcugaacguggagaccgacaccgccgagauccgccugauguguacggagaccuaccucgacaccccgcggcccaacgacggcagcaucaccgggcccugugaguccgacggcgacaagggcagcgggggcaucaagggcggguucgugcaccagcgcauggccuccaagaucgggcggugguauagccgcacgauguccaagaccaagcggaugggcaugggccuguacgucaaguacgacggggaccccuggaccgauagcgaggcgcuggcccucuccggcgugauggugagcauggaggagccggggugguacuccuucggcuucgagaucaaggauaagaagugcgacguccccugcaucgggaucgagauggugcacgacggcggcaagaccacguggcauagcgccgccaccgccaucuacugccugaugggguccggccagcugcucugggacaccgugaccggggucgacauggcgcuguga

SEQ ID NO: 29869 - RNA, 1401 nt, Artificial Sequence; identical to SEQ ID NO: 29868
  derived and/or modified CDS sequence (AUadapt) from InfluenzaB__AGX23318__NA

SEQ ID NO: 29870 - RNA, 1401 nt, Artificial Sequence; identical to SEQ ID NO: 29868
  derived and/or modified CDS sequence (AUadapt) from InfluenzaB__AGX23329__NA

SEQ ID NO: 29871 - RNA, 1401 nt, Artificial Sequence; identical to SEQ ID NO: 29868
  derived and/or modified CDS sequence (AUadapt) from InfluenzaB__AGX23340__NA

SEQ ID NO: 29872 - RNA, 1401 nt, Artificial Sequence; identical to SEQ ID NO: 29868
  derived and/or modified CDS sequence (AUadapt) from InfluenzaB__AGX23351__NA

SEQ ID NO: 29873 - RNA, 1401 nt, Artificial Sequence; identical to SEQ ID NO: 29868
  derived and/or modified CDS sequence (AUadapt) from InfluenzaB__AGX23362__NA

SEQ ID NO: 29874 - RNA, 1401 nt, Artificial Sequence; identical to SEQ ID NO: 29868
  derived and/or modified CDS sequence (AUadapt) from InfluenzaB__AGX23373__NA

SEQ ID NO: 29875 - RNA, 1401 nt, Artificial Sequence; identical to SEQ ID NO: 29868
  derived and/or modified CDS sequence (AUadapt) from InfluenzaB__AGX23384__NA

SEQ ID NO: 29876 - RNA, 1401 nt, Artificial Sequence
  derived and/or modified CDS sequence (AUadapt) from InfluenzaB__AGX23395__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaaugccagcaacgugcaggccgugaaccgcuccgccgccaagggcgucacgcuccugcugcccgagcccgaguggaccuacccgcggcucagcugucccggguccaccuuccagaaggcgcugcugaucucgccccaccgcuucggcgagaccaaggggaacuccgcgccccucaucauccgggagccguucaucgccuguggccccacggagugcaagcacuucgcccugacccacuacgccgcccagcccggcggguauuacaacggcacccgcgaggaccggaacaagcugcgccaccucaucagugugaagcuggggaagauccccaccguggagaacuccaucuuccacauggccgccuggagcggcuccgccugccaugacgggaaggaguggacguacgucggcguggacggcccggacagcaacgcgcugcucaagaucaaguauggggaggccuacaccgacaccuaccacuccuacgccaagaauauccugcggacccaggagagcgccugcaacugcaucggcggggacuguuaccugaugaucacggacggccccgccagcggcaucuccgagugccgcuuccucaagauccgggaggggcgcaucaucaaggagaucuuucccaccggccgggugaagcacaccgaggagugcacgugcggguucgcgucgaacaagaccaucgagugugccugccgcgacaacuccuacaccgccaagcggcccuucgucaagcugaauguggagaccgacaccgccgagauccgccugaugugcacggagaccuaccucgacaccccgcggcccaacgauggcagcaucaccgggcccugcgaguccgacggcgacaagggcagcgggggcaucaagggcggguuugugcaccagcgcauggccuccaagaucgggcggugguacagccgcacgauguccaagaccaagcggaugggcaugggccuguacgucaaguacgacggggaucccuggaccgacagcgaggcgcuggcccucuccggcgugauggugagcauggaggagccggggugguacuccuucggcuuugagaucaaggacaagaagugcgacguccccugcaucgggaucgagauggugcacgauggcggcaagaccacguggcacagcgccgccaccgccaucuacugccugaugggguccggccagcugcucuggaacaccgugaccggggucgacauggcgcuguga

SEQ ID NO: 29877 - RNA, 1401 nt, Artificial Sequence
  derived and/or modified CDS sequence (AUadapt) from InfluenzaB__AGX23417__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaacgccaguaacgugcaggccgugaaccgcuccgccgccaagggcgucacguuccuccugcccgagcccgaguggaccuacccgcggcugagcugccccggguccaccuuucagaaggcgcuccugaucucgccccaccgcuucggcgagaccaaggggaacuccgcgccccugaucauccgggagccguucaucgccuguggccccacggagugcaagcacuucgcccucacccacuacgccgcccagcccggcggguacuauaacggcacccgcgaggaccggaacaagcugcgccaccugaucagcgugaagcucgggaagauccccaccguggagaacuccaucuuucacauggccgccuggagcggcuccgccugccacgacgggaaggaguggacguauaucggcgucgacggcccggacagcaacgcgcugcugaagaucaaguacggggaggccuacaccgauaccuaccacuccuacgccaagaacauccuccggacccaggagagcgccugcaauugcaucggcggggacugcuaccugaugaucacggacggccccgccaguggcaucuccgagugccgcuuccugaagauccgggaggggcgcaucaucaaggagaucuuccccaccggccgggugaagcacaccgaggagugcacgugcggguuugcgucgaacaagaccaucgagugcgccugccgcgacaacuccuauaccgccaagcggcccuucgugaagcucaacgucgagaccgacaccgccgagauccgccugaugugcacggagaccuaccuggauaccccgcggcccaacgacggcagcaucaccgggcccugcgaguccgacggcgacaagggcagugggggcaucaagggcggguucgugcaccagcgcauggccuccaagaucgggcggugguacagccgcacgauguccaagaccaagcggaugggcaugggccucuacgugaaguacgauggggaccccuggaccgacagcgaggcgcuggcccuguccggcgucauggugagcauggaggagccggggugguacuccuuuggcuucgagaucaaggacaagaagugcgacgugcccugcaucgggaucgagaugguccacgauggcggcaagaccacguggcacagcgccgccaccgccaucuacugccucaugggguccggccagcugcugugggacaccgugaccgggguggacauggcgcucuga

SEQ ID NO: 29878 - RNA, 1401 nt, Artificial Sequence; identical to SEQ ID NO: 29877
  derived and/or modified CDS sequence (AUadapt) from InfluenzaB__AGX23428__NA

SEQ ID NO: 29879 - RNA, 1401 nt, Artificial Sequence; identical to SEQ ID NO: 29260
  derived and/or modified CDS sequence (AUadapt) from InfluenzaB__AGX23450__NA

SEQ ID NO: 29880 - RNA, 1401 nt, Artificial Sequence
  derived and/or modified CDS sequence (AUadapt) from InfluenzaB__AGX23461__NA
augcugcccaguaccauccagacccucacgcuguuccugaccuccggcggggugcuccugagccuguacgucuccgccagccucuccuaccugcuguauagcgacauccuccugaaguucucccgcaccgagaucaccgccccgaucaugccccuggacugcgcgaacgccaguaacauccaggccgugaaccgguccgccacgaagggcgugacccuccugcugcccgagcccgaguggaccuacccgcgccucagcugccccggguccaccuuucagaaggcccugcugaucagcccccaccgguucggcgagacgaaggggaacuccgcgccccucaucauccgcgagccguucaucgccugcggccccaaggaguguaagcacuucgcccugacccacuacgccgcgcagcccggcggguacuacaauggcacccgggaggaccgcaacaagcugcggcaccucaucagcgucaagcuggggaagauccccaccguggagaacuccaucuuucacauggccgccuggagcggcuccgccugccacgacgggcgcgaguggacguacaucggcguggauggcccggacucgaacgcccugcucaagaucaaguacggggaggcguacaccgauaccuaccacuccuacgccaagaacauccugcggacccaggagagcgccugcaauugcaucggcggggacugcuaccugaugaucacggacggccccgccagcggcaucuccgagugucgcuuccucaagauccgggaggggcgcaucaucaaggagaucuuccccaccggccgggucaagcacaccgaggagugcacgugcggguuugccagcaacaagaccaucgagugcgcgugccgcgacaacuccuauaccgccaagcggcccuucgugaagcugaacguggagaccgacaccgccgagauccgccugaugugcacggagaccuaccucgauaccccgcggcccaacgacggcagcaucaccgggcccugcgaguccaacggcgacaagggcagugggggcaucaagggcggguucguccaccagcgcauggccuccaagaucgggcggugguacagccgcacgauguccaagaccaagcggaugggcaugggccuguacgugaaguacgauggggaccccuggaccgacagcgaggcccuggcgcucuccggcgugauggucagcaucgaggagccggggugguacuccuuuggcuucgagaucaaggacaagaagugcgacgugcccugcaucgggaucgagauggugcacgauggcggcaagaccacguggcacagcgccgccaccgccaucuacugccugaugggguccggccagcugcucugggacaccgucaccgggguggacauggcccuguga

SEQ ID NO: 29881 - RNA, 1401 nt, Artificial Sequence; identical to SEQ ID NO: 29260
  derived and/or modified CDS sequence (AUadapt) from InfluenzaB__AGX23472__NA

SEQ ID NO: 29882 - RNA, 1401 nt, Artificial Sequence; identical to SEQ ID NO: 28901
  derived and/or modified CDS sequence (AUadapt) from InfluenzaB__AGX23483__NA

SEQ ID NO: 29883 - RNA, 1401 nt, Artificial Sequence
  derived and/or modified CDS sequence (AUadapt) from InfluenzaB__AGX23494__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgaucaugccccuggacugugcgaacgccagcaacgugcaggccgugaaccgcuccgccgccaagggcgucacgcuccugcugcccgagcccgaguggaccuacccgcggcucaguugccccggguccaccuuccagaaggcgcugcugaucagcccccaccgcuuuggcgagaccaaggggaacuccgcgccccucaucauccgggagccguucaucgccugcggccccacggagugcaagcacuuugcccugacccacuacgccgcccagcccggcggguacuacaacggcacccgcgaggaucggaacaagcugcgccaccucaucagcgugaagcuggggaagauccccaccguggagaacuccaucuuccauauggccgccuggagcggcuccgccugccacgacgggaaggaguggacguaugucggcguggacggcccggacagcaacgcgcugcucaagaucaaguacggggaggccuauaccgacaccuaccacuccuacgccaagaacauccugcggacccaggagagugccugcaacugcaucggcggggacuguuaccugaugaucacggacggccccgccagcggcaucuccgagugccgcuuccucaagauccgggaggggcgcaucaucaaggagaucuuucccaccggccgggugaagcacaccgaggagugcacgugcggguucgcgagcaauaagaccaucgagugcgccugccgcgacaacuccuacaccgccaagcggcccuuugucaagcugaacguggagaccgacaccgccgagauccgccugaugugcacggagaccuaccucgauaccccgcggcccaacgacggcagcaucaccgggcccugcggcuccgacggcgauaaggggagcggcgggaucaagggcggguucgugcaccagcgcauggccuccaagaucggccggugguacagccgcacgauguccaagaccaagcggaugggcauggggcuguaugucaaguacgacggcgaccccuggaccgacagugaggcgcuggcccucuccggggugauggugagcauggacgagccgggcugguacuccuucggguucgagaucaaggauaagaagugcgacguccccugcaucggcaucgagauggugcacgacggcgggaagaccacguggcauagcgccgccaccgccaucuacugccugaugggcuccgggcagcugcucugggacaccgugaccggcgucgacauggcgcuguga

SEQ ID NO: 29884 - RNA, 1401 nt, Artificial Sequence
  derived and/or modified CDS sequence (AUadapt) from InfluenzaB__AGX23505__NA
augcugcccaguaccauccagacccucacgcuguuccugaccuccggcggggugcuccugagccuguacgucuccgccagccucuccuaccugcuguauucggacauccuccugaaguucucccagaccgagaucaccgccccgaucaugccccuggacugcgcgaacgccaguaacgugcaggccgugaaccgcuccgccgccaagggcgucacgcuccugcugcccgagcccgaguggaccuacccgcggcucagcugccccggguccaccuuccagaaggcgcugcugaucaguccccaccgcuucggcgagaccaaggggaacuccgcgccccucaucauccgggagccguucaucgccugcggccccacggaguguaagcacuucgcccugacccacuacgccgcccagcccggcggguacuacaauggcacccgcgaggaccggaacaagcugcgccaccucaucucggugaagcuggggaagauccccaccguggagaacuccaucuuccauauggccgccuggagcggcuccgccugccacgacgggaaggaguggacguacaucggcgucgauggcccggacaacaacgcgcugcucaagaucaaguacggggaggccuacaccgacaccuaucacagcuacgccaagaacauccugcggacccaggaguccgccugcaacuguaucggcggggacugcuaccugaugaucacggacggccccgccagcggcaucagugagugccgcuuccucaagauccgggaggggcgcaucaucaaggagaucuuccccaccggccgggugaagcacaccgaggagugcacgugcggguuugcguccaacaagaccaucgagugcgccugccgcgacaacagcuauaccgccaagcggcccuucgugaagcugaacgucgagaccgacaccgccgagauccgccugaugugcacggagaccuaccucgauaccccgcggcccaacgacggcuccaucaccgggcccugcgagagcgacggcgacaagggcuccgggggcaucaagggcggguuugugcaccagcgcauggccagcaagaucgggcggugguacucccgcacgaugucgaagaccaagcggaugggcaugggccuguacgugaaguacgauggggaccccuggaccgacuccgaggcgcuggcccucagcggcgucaugguguccauggaggagccggggugguacagcuuuggcuucgagaucaaggacaagaagugcgacgugcccugcaucgggaucgagaugguccacgauggcggcaagaccacguggcacuccgccgccaccgccaucuacugccugauggggagcggccagcugcucugggacaccgugaccgggguggacauggcgcuguga

SEQ ID NO: 29885 - RNA, 1401 nt, Artificial Sequence
  derived and/or modified CDS sequence (AUadapt) from InfluenzaB__AGX23516__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgaucaugccccuggacugugcgaacgccagcaacgugcaggccgugaaccgcuccgccgccaagggcgucacgcuccugcugcccgagcccgaguggaccuacccgcggcucaguugccccggguccaccuuccagaaggcgcugcugaucagcccccaccgcuuuggcgagaccaaggggaacuccgcgccccucaucauccgggagccguucaucgccugcggccccacggagugcaagcacuuugcccugacccacuacgccgcccagcccggcggguacuacaacggcacccgcgaggaucggaacaagcugcgccaccucaucagcgugaagcuggggaagauccccaccguggagaacuccaucuuucacauggccgccuggagcggcuccgccugccacgacgggaaggaguggacguauaucggcgucgacggcccggacagcaacgcgcugcucaagaucaaguacggggaggccuauaccgacaccuaccacuccuacgccaagaauauccugcggacccaggagagcgccugcaacugcaucggcggggacuguuaccugaugaucacggacggccccgccagcggcguguccgagugccgcuuccucaagauccgggaggggcgcaucaucaaggagaucuuucccaccggccgggugaagcacaccgaggagugcacgugcggguucgcgaguaacaagaccaucgagugcgccugccgcgacaacuccuauaccgccaagcggcccuucgucaagcugaacguggagaccgacaccgccgagauccgccugaugugcacggagaccuaccucgauaccccgcggcccaacgacggcagcaucaccgggcccugcgaguccgauggcgacaagggcagcgggggcaucaagggcggguucgugcaccagcgcauggccuccaagaucgggcggugguacagucgcacgauguccaaggcgaagcggaugggcaugggccuguacgucaaguacgacggggaccccuggaccgacagugaggcccuggcccucuccggcgugauggugagcauggaggagccggggugguacuccuucggcuucgagaucaaggauaagaagugcgacguccccugcaucgggaucgagauggugcacgacggcggcaagaccaccuggcauagcgccgccacggcgaucuacugccugaugggguccggccagcugcucugggacaccgugaccggggucgacauggcccuguga

SEQ ID NO: 29886 - RNA, 1401 nt, Artificial Sequence; identical to SEQ ID NO: 28901
  derived and/or modified CDS sequence (AUadapt) from InfluenzaB__AGX23527__NA

SEQ ID NO: 29887 - RNA, 1401 nt, Artificial Sequence
  derived and/or modified CDS sequence (AUadapt) from InfluenzaB__AGX23538__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgaucaugccccuggacugugcgaacgccagcaacgugcaggccgugaaccgcuccgccgccaagggcgucacgcuccugcugcccaagcccgaguggaccuacccgcggcucaguugccccggguccaccuuccagaaggcgcugcugaucagcccccaccgcuucggcgagaccaaggggaauuccgcgccccucaucauccgggagccguucaucgccugcggccccacggagugcaagcacuucgcccugacccauuacgccgcccagcccggcggguacuacaacggcacccgcgaggaccggaauaagcugcgccaccucaucagcgugaagcuggggaagauccccaccguggagaacuccaucuuccacauggccgccuggaguggcuccgccugccacgacgggaaggaguggacguacaucggcgucgacggcccggauucgaacgcgcugcucaagaucaaguacggggaggccuacaccgacaccuaucacuccuacgccaagaacauccugcggacccaggagagcgccugcaauugcaucggcggggacugcuaccugaugaucacggacggccccgccaguggcguguccgagugccgcuuccucaagauccgggaggggcgcaucaucaaggagaucuuccccaccggccgggugaagcacaccgaggagugcacguguggguucgcgagcaacaagaccaucgagugcgccugccgcgauaacuccuacaccgccaagcggcccuucgucaagcugaacguggagaccgacaccgccgagauccgccugauguguacggagaccuaccucgacaccccgcggcccaacgacggcagcaucaccgggcccugugaguccgacggcgacaagggcagcgggggcaucaagggcggguucgugcaccagcgcauggccuccaagaucgggcggugguauagccgcacgauguccaccaccaagcggaugggcaugggccuguacgucaaguacgacggggaccccuggaccgauagcgaggcgcuggcccucuccggcgugauggugagcauggaggagccggggugguacuccuucggcuucgagaucaaggauaagaagugcgacguccccugcaucgggaucgagauggugcacgacggcggcaagacgaccuggcauagcgccgccaccgccaucuacugccugaugggguccggccagcugcucugggacaccgugacgggggucgacauggcgcuguga

SEQ ID NO: 29888 - RNA, 1401 nt, Artificial Sequence
  derived and/or modified CDS sequence (AUadapt) from InfluenzaB__AGX23549__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgaucaugccccuggacugugcgaacgccagcaacgugcaggccgugaaccgcuccgccgccaagggcgucacgcuccugcugcccgagcccgaguggaccuacccgcggcucaguugccccggguccaccuuccagaaggcgcugcugaucagcccccaccgcuuuggcgagaccaaggggaacuccgcgccccucaucauccgggagccguucaucgccugcggccccacggagugcaagcacuuugcccugacccacuacgccgcccagcccggcggguacuacaacggcacccgcgaggaucggaacaagcugcgccaccucaucagcgugaagcuggggaagauccccaccguggagaacuccaucuuucacauggccgccuggagcggcuccgccugccacgacgggaaggaguggacguauaucggcgucgacggcccggacagcaacgcgcugcucaagaucaaguacggggaggccuauaccgacaccuaccacuccuacgccaagaauauccugcggacccaggagagcgccugcaacugcaucggcggggacuguuaccugaugaucacggacggccccgccagcggcguguccgagugccgcuuccucaagauccgggaggggcgcaucaucaaggagaucuuucccaccggccgggugaagcacaccgaggagugcacgugcggguucgcgaguaacaagaccaucgagugcgccugccgcgacaacuccuauaccgccaagcggcccuucgucaagcugaacguggagaccgacaccgccgagauccgccugaugugcacggagaccuaccucgauaccccgcggcccaacgacggcagcaucaccgggcccugcgaguccgauggcgacaagggcagcgggggcaucaagggcggguucgugcaccagcgcauggccuccaagaucgggcggugguacagucgcacgauguccaccaccaagcggaugggcaugggccuguacgucaaguacgacggggaccccuggaccgacagugaggcgcuggcccucuccggcgugauggugagcauggaggagccggggugguacuccuucggcuucgagaucaaggauaagaagugcgacguccccugcaucgggaucgagauggugcacgacggcggcaagacgaccuggcauagcgccgccaccgccaucuacugccugaugggguccggccagcugcucugggacaccgugacgggggucgacauggcgcuguga

SEQ ID NO: 29889 - RNA, 1401 nt, Artificial Sequence; identical to SEQ ID NO: 28901
  derived and/or modified CDS sequence (AUadapt) from InfluenzaB__AGX23560__NA

SEQ ID NO: 29890 - RNA, 1401 nt, Artificial Sequence; identical to SEQ ID NO: 29883
  derived and/or modified CDS sequence (AUadapt) from InfluenzaB__AGX23571__NA

SEQ ID NO: 29891 - RNA, 1401 nt, Artificial Sequence; identical to SEQ ID NO: 29883
  derived and/or modified CDS sequence (AUadapt) from InfluenzaB__AGX23582__NA

SEQ ID NO: 29892 - RNA, 1401 nt, Artificial Sequence
  derived and/or modified CDS sequence (AUadapt) from InfluenzaB__AGX23593__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaacgccaguaacgugcaggccgugaaccgcuccgccgccaagggcgucacgcuccugcugcccgagcccgaguggaccuacccgcggcucagcugccccggguccaccuuucagaaggcgcugcugaucagcccccaccgcuucggcgagaccaaggggaacuccgcgccccucaucauccgggagccguucaucgccugcggccccacggaguguaagcacuucgcccugacccacuacgccgcccagcccggcggguacuacaauggcacccgcgaggaccggaacaagcugcgccaccucaucagcgugaagcuggggaagauccccaccguggagaacuccaucuuucacauggccgccuggagcggcuccgccugccacgacgggaaggaguggacguacaucggcgucgauggcccggacucgaacgcgcugcucaagaucaaguacggggaggccuacaccgauaccuaccacuccuacgccaagaacauccugcggacccaggagagcgccugcaauugcaucggcggggacugcuaccugaugaucacggacggccccgccagcggcaucuccgagugucgcuuccucaagauccgggaggggcgcaucaucaaggagaucuuccccaccggccgggugaagcacaccgaggagugcacgugcggguuugcgagcaacaagaccaucgagugcgccugccgcgacaacuccuauaccgccaagcggcccuucgugaagcugaacgucgagaccgacaccgccgagauccgccugaugugcacggagaccuaccucgauaccccgcggcccaacgacggcagcaucaccgggcccugcgaguccgacggcgacaagggcagugggggcaucaagggcggguucgugcaccagcgcauggccuccaagaucgggcggugguacagccgcacgauguccaagaccaagcggaugggcaugggccuguacgugaaguacgauggggaccccuggaccgacagcgaggcgcugacccucuccggcgucauggugagcauggaggagccggggugguacuccuuuggcuucgagaucaaggacaagaagugcgacgugcccugcaucgggaucgagaugguccacgauggcggcaagacgaccuggcacagcgccgccaccgccaucuacugccugaugggguccggccagcugcucugggacaccgugacggggguggacauggcccuguga

SEQ ID NO: 29893 - RNA, 1401 nt, Artificial Sequence; identical to SEQ ID NO: 28901
  derived and/or modified CDS sequence (AUadapt) from InfluenzaB__AGX23604__NA

SEQ ID NO: 29894 - RNA, 1401 nt, Artificial Sequence
  derived and/or modified CDS sequence (AUadapt) from InfluenzaB__AGX23615__NA
augcugcccaguaccauccagacccucacgcuguuccugaccuccggcggggugcuccugagccuguacgucuccgccagccucuccuaccugcuguauagcgacauccuccugaaguucucccagaccgagaucaccacgccgaucaugccccuggacugcgccaacgcgaguaacgugcaggccgugaaccgcuccgccgccaagggcgucacccuccugcugcccgagcccgaguggaccuacccgcggcucagcugccccggguccaccuuucagaaggcccugcugaucagcccccaccgcuucggcgagacgaaggggaacuccgcgccccucaucauccgggagccguucaucgccugcggccccaccgaguguaagcacuucgcccugacccacuacgccgcgcagcccggcggguacuacaauggcacccgcgaggaccggaacaagcugcgccaccucaucagcgugaagcuggggaagauccccacgguggagaacuccaucuuucacauggccgccuggagcggcuccgccugccacgacgggaaggaguggaccuacaucggcgucgauggcccggacucgaacgcccugcucaagaucaaguacggggaggcguacaccgauaccuaccacuccuacgccaagaacauccugcggacgcaggagagcgccugcaauugcaucggcggggacugcuaccugaugaucaccgacggccccgccagcggcaucuccgagugucgcuuccucaagauccgggaggggcgcaucaucaaggagaucuuccccaccggccgggugaagcacaccgaggagugcacgugcggguuugccagcaacaagaccaucgagugcgcgugccgcgacaacuccuauaccgccaagcggcccuucgugaagcugaacgucgagaccgacacggccgagauccgccugaugugcaccgagaccuaccucgauaccccgcggcccaacgacggcagcaucacggggcccugcgaguccgacggcgacaagggcagugggggcaucaagggcggguucgugcaccagcgcauggccuccaagaucgggcggugguacagccgcaccauguccaagaccaagcggaugggcaugggccuguacgugaaguacgauggggaccccuggaccgacagcgaggcccuggcgcucuccggcgucauggugagcauggaggagccggggugguacuccuuuggcuucgagaucaaggacaagaagugcgacgugcccugcaucgggaucgagaugguccacgauggcggcaagacgaccuggcacagcgccgccaccgccaucuacugccugaugggguccggccagcugcucugggacaccgugacggggguggacauggcccuguga

SEQ ID NO: 29895 - RNA, 1401 nt, Artificial Sequence; identical to SEQ ID NO: 29883
  derived and/or modified CDS sequence (AUadapt) from InfluenzaB__AGX23626__NA

SEQ ID NO: 29896 - RNA, 1401 nt, Artificial Sequence; identical to SEQ ID NO: 29260
  derived and/or modified CDS sequence (AUadapt) from InfluenzaB__AGX23637__NA

SEQ ID NO: 29897 - RNA, 1401 nt, Artificial Sequence; identical to SEQ ID NO: 28901
  derived and/or modified CDS sequence (AUadapt) from InfluenzaB__AGX23659__NA

SEQ ID NO: 29898 - RNA, 1401 nt, Artificial Sequence; identical to SEQ ID NO: 29260
  derived and/or modified CDS sequence (AUadapt) from InfluenzaB__AGX23670__NA

SEQ ID NO: 29899 - RNA, 1401 nt, Artificial Sequence; identical to SEQ ID NO: 29260
  derived and/or modified CDS sequence (AUadapt) from InfluenzaB__AGX23681__NA

SEQ ID NO: 29900 - RNA, 1401 nt, Artificial Sequence; identical to SEQ ID NO: 29260
  derived and/or modified CDS sequence (AUadapt) from InfluenzaB__AGX23692__NA

SEQ ID NO: 29901 - RNA, 1401 nt, Artificial Sequence; identical to SEQ ID NO: 29260
  derived and/or modified CDS sequence (AUadapt) from InfluenzaB__AGX23703__NA

SEQ ID NO: 29902 - RNA, 1401 nt, Artificial Sequence
  derived and/or modified CDS sequence (AUadapt) from InfluenzaB__AGX23714__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaaugccagcaacgugcaggccgugaaccgcuccgccgccaagggcgucacgcuccugcugcccgagcccgaguggaccuacccgcggcucagcugucccggguccaccuuccagaaggcgcugcugaucagcccccaccgcuucggcgagaccaaggggaacuccgcgccccucaucauccgggagccguuuaucgccugcggccccacggagugcaagcacuucgcccugacccacuaugccgcccagcccggcggguacuacaacggcacccgcgaggaccggaacaagcugcgccaucucaucagcgugaagcuggggaagauccccaccguggagaacuccaucuuccacauggccgccuggagcggcuccgccugucacgacgggaaggaguggacguacgucggcguggacggcccggacaguaacgcgcugcucaagaucaaguacggggaggccuacaccgacaccuaccauuccuacgagaagaacauccugcggacccaggagagcgccugcaacuguaucggcggggacugcuaccugaugaucacggacggccccgccagcggcaucuccgagugucgcuuccucaagauccgggaggggcgcaucaucaaggagaucuuccccaccggccgggugaagcacaccgaggagugcacgugcggguuugccagcaacaagaccaucgagugcgcgugccgcgacaauuccuacaccgccaagcggcccuucgucaagcugaacguggagaccgacaccgccgagauccgccugaugugcacggagaccuaucucgacaccccgcggcccaacgacggcagcaucaccgggcccugcggcuccgauggcgacaaggggagcggcgggaucaagggcggguucgugcaccagcgcauggccuccaagaucggccggugguacagucgcacgauguccaagaccaagcggaugggcauggggcuguacgucaaguacgacggcgaccccuggaccgacagugaggcccuggcgcucuccggggugauggugagcauggacgagccgggcugguacuccuucggguucgagaucaaggauaagaagugcgacguccccugcaucggcaucgagauggugcacgacggcgggaagaccacguggcauagcgccgccaccgccaucuacugccugaugggcuccgggcagcugcucugggacaccgugaccggcgucgacauggcccuguga

SEQ ID NO: 29903 - RNA, 1401 nt, Artificial Sequence; identical to SEQ ID NO: 29260
  derived and/or modified CDS sequence (AUadapt) from InfluenzaB__AGX23725__NA

SEQ ID NO: 29904 - RNA, 1401 nt, Artificial Sequence; identical to SEQ ID NO: 29883
  derived and/or modified CDS sequence (AUadapt) from InfluenzaB__AGX23736__NA

SEQ ID NO: 29905 - RNA, 1401 nt, Artificial Sequence; identical to SEQ ID NO: 29260
  derived and/or modified CDS sequence (AUadapt) from InfluenzaB__AGX23747__NA

SEQ ID NO: 29906 - RNA, 1401 nt, Artificial Sequence; identical to SEQ ID NO: 29260
  derived and/or modified CDS sequence (AUadapt) from InfluenzaB__AGX23758__NA

SEQ ID NO: 29907 - RNA, 1401 nt, Artificial Sequence; identical to SEQ ID NO: 29883
  derived and/or modified CDS sequence (AUadapt) from InfluenzaB__AGX23769__NA

SEQ ID NO: 29908 - RNA, 1401 nt, Artificial Sequence
  derived and/or modified CDS sequence (AUadapt) from InfluenzaB__AGX23780__NA
augcugcccaguaccauccagacccucacgcugcugcucaccuccggcggggugcugcugagccucuacgucuccgccagccuguccuaccugcucuauagcgacauccugcugaaguucucccagaccgagaucaccgccccgaucaugccccucgacugcgcgaaugccagcaacgugcaggccgugaaccgcuccgccgccaagggcgucacgcugcugcuccccgagcccgaguggaccuacccgcggcugaguugccccggguccaccuuccagaaggcgcugcucaucagcccccaccgcuucggcgagaccaaggggaauuccgcgccccugaucauccgggagccguucaucgccugcggccccacggagugcaagcacuucgcccugacccauuacgccgcccagcccggcggguacuacaacggcacccgcgaggaucggaacaagcuccgccaccugaucagcgugaagcuggggaagauccccaccguggagaacuccaucuuccauauggccgccuggagcggcuccgccugccacgacgggaaggaguggacguauaucggcgucgacggcccggacucgaacgcgcuccugaagaucaaguacggggaggccuauaccgacaccuaccacuccuacgccaagaacauccugcggacccaggagagugccugcaacugcaucggcggggacuguuaccucaugaucacggacggccccgccagcggcguguccgagugccgcuuccugaagauccgggaggggcgcaucaucaaggagaucuuucccaccggccgggugaagcacaccgaggagugcacgugcggguucgcgagcaauaagaccaucgagugcgccugccgcgacaacuccuauaccgccaagcggcccuucgucaagcugaacguggagaccgacaccgccgagauccgccucaugugcacggagaccuaccuggauaccccgcggcccaacgacggcagcaucaccgggcccugcgaguccgauggcgacaagggcagcgggggcaucaagggcggguucgugcaccagcgcauggccuccaagaucgggcggugguacagucgcacgauguccaagaccaagcggaugggcaugggccuguacgucaaguacgacggggaccccuggaccgacagugaggcgcucgcccuguccggcgugauggugagcauggaggagccggggugguacuccuucggcuucgagaucaaggauaagaagugcgacguccccugcaucgggaucgagauggugcacgacggcggcaagaccacguggcauagcgccgccaccgccaucuacugccugaugggguccggccagcuccugugggacaccgugaccggggucgacauggcgcuguga

SEQ ID NO: 29909 - RNA, 1401 nt, Artificial Sequence
  derived and/or modified CDS sequence (AUadapt) from InfluenzaB__AGX23791__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgaucaugccccuggacugugcgaacgccagcaacgcccaggccgugaaccgcuccgccgcgaagggcgugacgcuccugcugcccgagcccgaguggaccuacccgcggcucaguugccccggguccaccuuccagaaggcccugcugaucagcccccaccgcuuuggcgagaccaaggggaacuccgcgccccucaucauccgggagccguucaucgccugcggccccacggagugcaagcacuuugcccugacccacuacgccgcccagcccggcggguacuacaacggcacccgcgaggaucggaacaagcugcgccaccucaucagcgucaagcuggggaagauccccaccguggagaacuccaucuuucacauggccgccuggagcggcuccgcgugccacgacgggaaggaguggacguauaucggcguggacggcccggacucgaacgcccugcucaagaucaaguacggggaggccuauaccgacaccuaccacuccuacgccaagaauauccugcggacccaggagagcgccugcaacugcaucggcggggacuguuaccugaugaucacggacggccccgcgagcggcgucuccgagugccgcuuccucaagauccgggaggggcgcaucaucaaggagaucuuucccaccggccgggugaagcacaccgaggagugcacgugcggguucgccaguaacaagaccaucgagugcgccugccgcgacaacuccuauaccgccaagcggcccuucgugaagcugaacgucgagaccgacaccgccgagauccgccugaugugcacggagaccuaccucgauaccccgcggcccaacgacggcagcaucaccgggcccugcgaguccgauggcgacaagggcagcgggggcaucaagggcggguucgugcaccagcgcauggcguccaagaucgggcggugguacagucgcacgauguccaagaccaagcggaugggcaugggccuguacgugaaguacgacggggaccccuggaccgacagugaggcccuggcccucuccggcgucauggugagcauggaggagccggggugguacuccuucggcuucgagaucaaggauaagaagugcgacgugcccugcaucgggaucgagaugguccacgacggcggcaagaccacguggcauagcgccgccaccgcgaucuacugccugaugggguccggccagcugcucugggacaccgugaccgggguggacauggcccuguga

SEQ ID NO: 29910 - RNA, 1401 nt, Artificial Sequence; identical to SEQ ID NO: 29883
  derived and/or modified CDS sequence (AUadapt) from InfluenzaB__AGX23802__NA

SEQ ID NO: 29911 - RNA, 1401 nt, Artificial Sequence; identical to SEQ ID NO: 29883
  derived and/or modified CDS sequence (AUadapt) from InfluenzaB__AGX23813__NA

SEQ ID NO: 29912 - RNA, 1401 nt, Artificial Sequence; identical to SEQ ID NO: 29883
  derived and/or modified CDS sequence (AUadapt) from InfluenzaB__AGX23824__NA

SEQ ID NO: 29913 - RNA, 1401 nt, Artificial Sequence; identical to SEQ ID NO: 29883
  derived and/or modified CDS sequence (AUadapt) from InfluenzaB__AGX23846__NA

SEQ ID NO: 29914 - RNA, 1401 nt, Artificial Sequence; identical to SEQ ID NO: 28901
  derived and/or modified CDS sequence (AUadapt) from InfluenzaB__AGX23857__NA

SEQ ID NO: 29915 - RNA, 1401 nt, Artificial Sequence; identical to SEQ ID NO: 29883
  derived and/or modified CDS sequence (AUadapt) from InfluenzaB__AGX23868__NA

SEQ ID NO: 29916 - RNA, 1401 nt, Artificial Sequence
  derived and/or modified CDS sequence (AUadapt) from InfluenzaB__AGX23879__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgaucaugccccuggacugugcgaacgccagcaacgugcaggccgugaaccgcuccgccgccaagggcgucacgcuccugcugcccgagcccgaguggaccuauccgcggcucagcugccccggguccaccuuccagaaggcgcugcugaucagcccccaccgcuuuggcgagaccaaggggaacuccgcgccccucaucauccgggagccguucaucgccugcggccccacggagugcaagcacuuugcccugacccacuacgccgcccagcccggcggguacuacaauggcacccgcgaggaccggaacaagcugcgccaccucaucagcgugaagcuggggaagauccccaccguggagacguccaucuuccauauggccgccuggagcggcuccgccugccacgacgggaaggaguggaccuauaucggcgucgacggcccggacagcaacgcgcugcucaagaucaaguacggggaggccuauaccgacaccuaccacuccuacgccaagaacauccugcggacgcaggagagugccugcaacugcaucggcggggacuguuaccugaugaucaccgacggccccgccagcggcguguccgagugccgcuuccucaagauccgggaggggcgcaucaucaaggagaucuuucccaccggccgggugaagcacaccgaggagugcacgugcggguucgcgagcaauaagaccaucgagugcgccugccgcgacaacuccuauaccgccaagcggcccuucgucaagcugaacguggagaccgacacggccgagauccgccugaugugcaccgagaccuaccucgauaccccgcggcccaacgacggcagcaucacggggcccugcgaguccgauggcgacaagggcagcgggggcaucaagggcggguucgugcaccagcgcauggccuccaagaucgggcggugguacagucgcaccauguccaagaccaagcggaugggcaugggccuguacgucaaguacgacggggaccccuggaccgacagugaggcgcuggcccucuccggcgugauggugagcauggaggagccggggugguacuccuucggcuucgagaucaaggauaagaagugcgacguccccugcaucgggaucgagauggugcacgacggcggcaagacgaccuggcauagcgccgccaccgccaucuacugccugaugggguccggccagcugcucugggacaccgugacgggggucgacauggcgcuguga

SEQ ID NO: 29917 - RNA, 1401 nt, Artificial Sequence; identical to SEQ ID NO: 29883
  derived and/or modified CDS sequence (AUadapt) from InfluenzaB__AGX23890__NA

SEQ ID NO: 29918 - RNA, 1401 nt, Artificial Sequence; identical to SEQ ID NO: 28901
  derived and/or modified CDS sequence (AUadapt) from InfluenzaB__AGX23901__NA

SEQ ID NO: 29919 - RNA, 1401 nt, Artificial Sequence
  derived and/or modified CDS sequence (AUadapt) from InfluenzaB__AGX23912__NA
augcugcccaguaccauccaaacccucacgcuguuccugaccuccggcggggugcuccugagccuguacgucuccgccagccucuccuaucugcuguacagcgacauccuccugaaguucucccagaccgagaucaccgccccgaucaugccccuggauugcgcgaacgccagcaacgugcaggccgugaaccgcuccgccgccaagggcgucacgcuccugcugcccgagcccgaguggaccuauccgcggcucagcugccccggguccaccuuccagaaggcgcugcugaucagcccccaucgcuucggcgagaccaaggggaacuccgcgccccucaucauccgggagccguucaucgccugcggccccacggagugcaagcauuucgcccugacccacuacgccgcccagcccggcggguacuauaacggcacccgcgaggaccggaaccgccugcggcaccucaucagcgugaagcuggggaagauccccaccguggagaauuccaucuuccacauggccgccuggagcggcuccgccugccaugacgggaaggaguggacguacgucggcguggacggcccggacagcaaugcgcugcucaagaucaaguacggggaggccuacaccgacaccuaccauuccuacgccaagaacauccugcgcacccaggagagcgccugcaauugcaucggcggggacugcuaccugaugaucacggacggccccgccaguggcaucuccgagugccgguuccucaagauccgcgaggggcggaucaucaaggagaucuuccccaccggccgcgugaagcacaccgaggaguguacgugcggguucgcgagcaacaagaccaucgagugcgccugucgggacaacuccuacaccgccaagcgccccuucgucaagcugaauguggagaccgacaccgccgagauccggcugaugugcacggagaccuaccucgacaccccgcgccccaacgauggcagcaucaccgggcccugcggcuccgacggcgacaaggggaguggcgggaucaagggcggguucgugcaccagcggauggccuccaagaucggccgcugguacagccggacgauguccaagaccaagcgcaugggcauggggcuguacgucaaguaugacggcgaccccuggaccgacagcgaggcgcuggcccucuccggggugauggugaguauggacgagccgggcugguacuccuucggguucgagaucaaggacaagaagugugacguccccugcaucggcaucgagauggugcacgacggcgggaagaccacguggcauagcgccgccaccgccaucuacugccugaugggcuccgggcagcugcucugggacaccgugaccggcgucgacauggcgcuguga

SEQ ID NO: 29920 - RNA, 1401 nt, Artificial Sequence; identical to SEQ ID NO: 29073
  derived and/or modified CDS sequence (AUadapt) from InfluenzaB__AGX23934__NA

SEQ ID NO: 29921 - RNA, 1401 nt, Artificial Sequence
  derived and/or modified CDS sequence (AUadapt) from InfluenzaB__AGX23945__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaaugccagcaacgugcaggccgugaaccgcuccgccgccaagggcgucacgcuccugcugcccgagcccgaguggaccuacccgcggcucagcugucccggguccaccuuccagaaggcgcugcugaucagcccccaccgcuucggcgagaccaaggggaacuccgcgccccucaucauccgggagccguuuaucgccugcggccccacggagugcaagcacuucgcccugacccacuaugccgcccagcccggcggguacuacaacggcacccgcgaggaccggaacaagcugcgccaucucaucagcgugaagcuggggaagauccccaccguggagaacuccaucuuccacauggccgccuggagcggcuccgccugucacgacgggaaggaguggacguacgucggcguggacggcccggacaguaacgcgcugcucaagaucaaguacggggaggccuacaccgacaccuaccauuccuacgccaagaacauccugcggacccaggagagcgccugcaacuguaucggcggggacugcuaccugaugaucacggacggccccgccagcggcaucuccgagugucgcuuccucaagauccgggaggggcgcaucaucaaggagaucuuccccaccggccggaucaagcacaccgaggagugcacgugcggguuugcgagcaacaagaccaucgagugcgccugccgcgacaauuccuacaccgccaagcggcccuucgugaagcugaacgucgagaccgacaccgccgagauccgccugaugugcacggagaccuaucucgacaccccgcggcccaacgacggcagcaucaccgggcccugcggcuccgauggcgacaaggggagcggcgggaucaagggcggguucgugcaccagcgcauggccuccaagaucggccggugguacagucgcacgauguccaagaccaagcggaugggcauggggcuguacgugaaguacgacggcgaccccuggaccgacagugaggcgcuggcccucuccggggucauggugagcauggacgagccgggcugguacuccuucggguucgagaucaaggauaagaagugcgacgugcccugcaucggcaucgagaugguccacgacggcgggaagaccacguggcauagcgccgccaccgccaucuacugccugaugggcuccgggcagcugcucugggacaccgugaccggcguggacauggcgcuguga

SEQ ID NO: 29922 - RNA, 1401 nt, Artificial Sequence
  derived and/or modified CDS sequence (AUadapt) from InfluenzaB__AGX23956__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaaugccagcaacgugcaggccgugaaccgcuccgccgccaagggcgucacgcuccugcugcccgagcccgaguggaccuacccgcggcucagcugucccggguccaccuuccagaaggcgcugcugaucucgccccaccgcuucggcgagaccaaggggaacuccgcgccccucaucauccgggagccguucaucgccuguggccccacggagugcaagcacuucgcccugacccacuacgccgcccagcccggcggguauuacaacggcacccgcgaggaccggaacaagcugcgccaccucaucagugugaagcuggggaagauccccaccguggagaacuccaucuuccacauggccgccuggagcggcuccgccugccaugacgggaaggaguggacguacaucggcaucgacggcccggacagcaacgcgcugcucaagaucaaguauggggaggccuacaccgacaccuaccacuccuacgccaagaauauccugcggacccaggagagcgccugcaacugcaucggcggggacuguuaccugaugaucacggacggccccgccagcggcgucuccgagugccgcuuccucaagauccgggaggggcgcaucaucaaggagaucuuucccaccggccgggugaagcacaccgaggagugcacgugcggguucgcgucgaacaagaccaucgagugugccugccgcgacaacuccuacaccgccaagcggcccuucgugaagcugaaugucgagaccgacaccgccgagauccgccugaugugcacggagaccuaccucgacaccccgcggcccaacgauggcagcaucaccgggcccugcgaguccgacggcgacaagggcagcgggggcaucaagggcggguuugugcaccagcgcauggccuccaagaucgggcggugguacagccgcacgauguccaagaccaagcggaugggcaugggccuguacgugaaguacgacggggaucccuggaccgacagcgaggcgcuggcccucuccggcgucauggugagcauggaggagccggggugguacuccuucggcuuugagaucaaggacaagaagugcgacgugcccugcaucgggaucgagaugguccacgauggcggcaagaccacguggcacagcgccgccaccgccaucuacugccugaugggguccggccagcugcucugggacaccgugaccgggguggacauggcgcuguga

SEQ ID NO: 29923 - RNA, 1401 nt, Artificial Sequence; identical to SEQ ID NO: 29260
  derived and/or modified CDS sequence (AUadapt) from InfluenzaB__AGX23967__NA

SEQ ID NO: 29924 - RNA, 1401 nt, Artificial Sequence; identical to SEQ ID NO: 29073
  derived and/or modified CDS sequence (AUadapt) from InfluenzaB__AGX23978__NA

SEQ ID NO: 29925 - RNA, 1401 nt, Artificial Sequence
  derived and/or modified CDS sequence (AUadapt) from InfluenzaB__AGX23989__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgaucaugccccuggacugugcgaacgccagcaacgugcaggccgugaaccgcuccgccgccaagggcgucacgcuccugcugcccgagcccgaguggaccuacccgcggcucaguugccccggguccaccuuccagaaggcgcugcugaucucgccccaccgcuucggcgagaccaaggggaauuccgcgccccucaucauccgggagccguucaucgccugcggccccacggagugcaagcacuucgcccugacccauuacgccgcccagcccggcggguacuacaacggcacccgcgaggaccggaauaagcugcgccaccucaucagcgugaagcuggggaagauccccaccguggagaacuccaucuuccacauggccgccuggaguggcuccgccugccacgacgggaaggaguggacguacaucggcgucgacggcccggauagcaacgcgcugcucaagaucaaguacggggaggccuacaccgacaccuaucacuccuacgccaagaacauccugcggacccaggagagcgccugcaauugcaucggcggggacugcuaccugaugaucacggacggccccgccaguggcaucuccgagugccgcuuccucaagauccgggaggggcgcaucaucaaggagaucuuccccaccggccgggugaagcacaccgaggagugcacguguggguucgcgucgaacaagaccaucgagugcgccugccgcgauaaccgguacaccgccaagcgccccuucgugaagcugaacgucgagaccgacaaggccgagauccggcugauguguaccgagacguaccucgacaccccgcgccccaacgacggcuccaucaccgggcccugcgagagugacggcgacaagggcuccgggggcaucaagggcggguucgugcaccagcggauggccagcaagaucgggcgcugguauucccggaccaugagcaagacgaagcgcaugggcaugggccuguacgugaaguacgacggggaccccuggaccgauuccggcgcgcuggcccucagcggggucaugguguccaucgaggagccgggcugguacagcuucggguucgagaucaaggauaagaagugcgacgugcccugcaucggcaucgagaugguccacgacggcgggaagaccaccuggcauuccgccgccacggccaucuacugccugaugggcagcgggcagcugcucugggacaccgugaccggcguggacauggcgcuguga

SEQ ID NO: 29926 - RNA, 1401 nt, Artificial Sequence; identical to SEQ ID NO: 29883
  derived and/or modified CDS sequence (AUadapt) from InfluenzaB__AGX24000__NA

SEQ ID NO: 29927 - RNA, 1401 nt, Artificial Sequence
  derived and/or modified CDS sequence (AUadapt) from InfluenzaB__AGX24011__NA
augcugcccaguaccauccagacccucacgcuguuccugaccuccggcggggugcuccugagccuguacgucuccgccagccucuccuaccugcuguacagugacauccuccugaaguucucccagaccgagaucaccgccccgaucaugccccuggacuacgcgaacgccagcaacgugcaggccgugaaucacuccgccgccaagggcgucacgcuccugcugcccgagcccgaguggaccuacccgcgccucagcugccccggguccaccuuccagaaggcgcugcugaucagcccccaucgguucggcgagaccaaggggaacuccgcgccccucaucauccgcgagccguucaucgccugcggccccacggagugcaagcacuucgcccugacccauuacgccgcccagcccggcggguacuacaacggcacccgggaggaccgcaacaagcugcggcaucucaucucggugaagcuggggaagauccccaccguggagaacuccaucuuccacauggccgccuggagcggcuccgccugccacgaugggaaggaguggacguacaucggcgucgacggcccggacagcaacgcgcugcucaagaucaaguacggggaggccuauaucgacaccuaccacuccuacgccaagaacauccugcgcacccaggagagcgccugcaauugcaucggcggggacugcuaccugaugaucaccgacggccccgccucgggcaucuccgagugucgguuccucaagauccgcgaggggcggaucaucaaggagaucuuccccacgggccgcgugaagcacaccgaggagugcacgugcggguucgcgagcaauaagaccaucgagugcgccugccgggacaacuccuacaccgccaagcgccccuucgugaagcugaaugucgagaccgacaccgccgagauccggcugaugugcaccgagacguaccucgacaccccgcgccccaacgacggcagcaucaccgggcccugugaguccgacggcgacaagggcagcgggggcaucaagggcggguucgugcaccagcggauggccuccaagaucgggcgcugguacagucggaccauguccaagacgaagcgcaugggcaugggccuguacgugaaguacgacggggaccccuggaccgacagcgaggcgcuggcccucuccggcgucauggugagcauggaggagccggggugguauuccuucggcuucgagaucaaggacaagaagugcgacgugcccugcaucgggaucgagaugguccaugacggcggcaagaccaccuggcacagcgccgccacggccaucuacugccugaugggguccggccagcugcucugggacaccgugaccgggguggacauggcgcuguga

SEQ ID NO: 29928 - RNA, 1401 nt, Artificial Sequence; identical to SEQ ID NO: 29073
  derived and/or modified CDS sequence (AUadapt) from InfluenzaB__AGX24022__NA

SEQ ID NO: 29929 - RNA, 1401 nt, Artificial Sequence
  derived and/or modified CDS sequence (AUadapt) from InfluenzaB__AGX24033__NA
augcugcccaguaccauccagacccucacgcuguuccugaccuccggcggggugcuccugagccuguacgucuccgccagccucuccuaccugcuguauagcgacauccuccugaaguucucccagaccgagaucaccgcccagaucaugccgcuggacugcgcgaaugccucgaacgugcaggccgugaaccgcuccgccgccaagggcgucacgcuccugcugcccgagcccgaguggaccuacccccggcucagcuguccgggguccaccuuccagaaggcgcugcugaucagcccccaccgcuucggcgagaccaaggggaacuccgcgccccucaucauccgggagcccuucaucgccuguggcccgacggagugcaagcacuucgcccugacccacuacgccgcccagcccggcggguauuacaacggcacccgcgaggaccggaacaagcugcgccaccucaucagugugaagcuggggaagauccccaccguggagaacuccaucuuccacauggccgccuggagcggcuccgccugccaugacgggaaggaguggacguacaucggcgucgacggccccgacucgaacgcgcugcucaagaucaaguauggggaggccuacaccgacaccuaccacuccuacgccaagaauauccugcggacccaggagagcgccugcaacugcaucggcggggacuguuaccugaugaucacggacggcccggccagcggcaucuccgagugccgcuuccucaagauccgggaggggcgcaucaucaaggagaucuuucccaccggccgggugaagcacaccgaggagugcacgugcggguucgcgagcaacaagaccaucgagugugccugccgcgacaaccgguacaccgccaagcgccccuucgugaagcugaaugucgagaccgacaaggccgagauccggcugaugugcaccgagacguaccucgacacgccccgcccgaacgauggcuccaucaccgggcccugcgagagcgacggcgacaagggcuccgggggcaucaagggcggguucgugcaucagcggauggccucgaagaucgggcgcugguacucccggaccaugagcaagaccaagcgcaugggcaugggccuguacgugaaguacgacggggaucccuggaccgacuccggcgcgcuggcccucagcggggucaugguguccaucgaggagcccggcugguacagcuucggguuugagaucaaggacaagaagugcgacgugccgugcaucggcaucgagaugguccacgauggcgggaagaccaccuggcacuccgccgccacggccaucuacugccugaugggcagcgggcagcugcucugggacaccgugaccggcguggacauggcgcuguga

SEQ ID NO: 29930 - RNA, 1401 nt, Artificial Sequence; identical to SEQ ID NO: 29073
  derived and/or modified CDS sequence (AUadapt) from InfluenzaB__AGX24044__NA

SEQ ID NO: 29931 - RNA, 1401 nt, Artificial Sequence
  derived and/or modified CDS sequence (AUadapt) from InfluenzaB__AGX24055__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaacgccaguaacgugcaggccgugaaccgcuccgccacgaagggcgucacccuccugcugcccgagcucgaguggaccuacccccggcugagcugcccgggguccaccuuucagaaggcccugcucaucucgccccaccgcuucggcgagacgaaggggaacuccgcgccccugaucauccgggagcccuucguggccugcggcccgaccgaguguaagcacuucgcccugacccacuacgccgcgcagcccggcggguacuacaauggcacccgcgaggaccggaacaagcuccgccaccugaucagcgugaagcuggggaagauccccacggucgagaacuccaucuuucacauggccgccuggagcggcuccgccugccacgacgggaaggaguggaccuacaucggcguggauggccccaacagcaacgcccuccugaagaucaaguacggggaggcguacaccgauaccuaccacuccuacgccaagaacauccugcggacgcaggagagcgccugcaauugcaucggcggggacugcuaccucaugaucaccgacggcccggccagcggcguguccgagugucgcuuccugaagauccgggaggggcgcaucaucaaggagaucuuccccaccggccgggucaagcacaccgaggagugcacgugcggguuugccucgaacaagaccaucgagugcgcgugccgcgacaacuccuauaccgccaagcggcccuucgugaagcugaacguggagaccgacacggccgagauccgccucaugugcaccgagaccuaccuggauacgccccggccgaacgacggcagcaucaccgggcccugcgaguccgacggcgacaagggcagugggggcaucaagggcggguucguccaccagcgcauggccuccaagaucgggcggugguacagccgcaccauguccaagaccaagcggaugggcaugggccuguacgugaaguacgauggggaccccuggaccgacagcgaggcccucgcgcuguccggcgugauggucagcauggaggagcccgggugguacuccuuuggcuucgagaucaaggacaagaagugcgacgugccgugcaucgggaucgagauggugcacgauggcggcaagacgaccuggcacagcgccgccaccgccaucuacugccugaugggguccggccagcuccugugggacaccgucacggggguggacauggcccuguga

SEQ ID NO: 29932 - RNA, 1401 nt, Artificial Sequence; identical to SEQ ID NO: 28686
  derived and/or modified CDS sequence (AUadapt) from InfluenzaB__AGX24066__NA

SEQ ID NO: 29933 - RNA, 1401 nt, Artificial Sequence
  derived and/or modified CDS sequence (AUadapt) from InfluenzaB__AGX24077__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgaucaugccccuggacugugcgaacgccagcaacgugcaggccgugaaccgcuccgccgccaagggcgucacgcuccugcugcccgagcccgaguggaccuacccgcggcucaguugccccggguccaccuuccagaaggcgcugcugaucucgccccaccgcuucggcgagaccaaggggaauuccgcgccccucaucauccgggagccguucaucgccugcggccccacggagugcaagcacuucgcccugacccauuacgccgcccagcccggcggguacuacaacggcacccgcgaggaccggaauaagcugcgccaccucaucagcgugaagcuggggaagauccccaccguggagaacuccaucuuccacauggccgccuggaguggcuccgccugccacgacgggaaggaguggacguacaucggcgucgacggcccggauagcaacgcgcugcucaagaucaaguacggggaggccuacaccgacaccuaucacuccuacgccaagaacauccugcggacccaggagagcgccugcaauugcaucggcgggaacugcuaccugaugaucacggacggccccgccaguggcaucuccgagugccgcuuccucaagauccgggaggggcgcaucaucaaggagaucuuccccaccggccgggugaagcacaccgaggagugcacguguggguucgcgucgaacaagaccaucgagugcgccugccgcgauaaccgguacaccgccaagcgccccuucgugaagcugaacgucgagaccgacaaggccgagauccggcugauguguaccgagacguaccucgacaccccgcgccccaacgacggcuccaucaccgggcccugcgagagugacggcgacaagggcuccgggggcaucaagggcggguucgugcaccagcggauggccagcaagaucgggcgcugguauucccggaccaugagcaagacgaagcgcaugggcaugggccuguacgugaaguacgacggggaccccugggcggauuccggcgcccuggcccucagcggggucaugguguccaucgaggagccgggcugguacagcuucggguucgagaucaaggauaagaagugcgacgugcccugcaucggcaucgagaugguccacgacggcgggaagaccaccuggcauuccgccgccaccgcgaucuacugccugaugggcagcgggcagcugcucugggacacggugaccggcguggacauggcccuguga

SEQ ID NO: 29934 - RNA, 1401 nt, Artificial Sequence
  derived and/or modified CDS sequence (AUadapt) from InfluenzaB__AGX24088__NA
augcugcccaguaccauccagacccucacgcuguucaucaccuccggcggggugcugcucagccuguacgucuccgccagccuguccuaucuccuguacagcgacauccugcucaaguucucccagaccgagaucaccgccccgaucaugccccuggacugugcgaacgccagcaacgugcaggccgugaaccgcuccgccgccaagggcgucacgcugcuccugcccgagcccgaguggaccuacccgcggcugaguugccccggguccaccuuccagaaggcgcuccugaucagcccccaccgcuuuggcgagaccaaggggaacuccgcgccccugaucauccgggagccguucaucgccugcggccccacggagugcaagcacuuugcccucacccacuacgccgcccagcccggcggguacuacaacggcacccgcgaggaucggaacaagcugcgccaccugaucagcgugaagcucgggaagauccccaccguggagaacuccaucuuccauauggccgccuggagcggcuccgccugccacgacgggaaggaguggacguaugucggcguggacggcccggacagcgacgcgcugcugaagaucaaguacggggaggccuauaccgacaccuaccacuccuacgccaagaacauccuccggacccaggagagugccugcaacugcaucggcggggacuguuaccugaugaucacggacggccccgccagcggcaucuccgagugccgcuuccugaagauccgggaggggcgcaucaucaaggagaucuuucccaccggccgggugaagcacaccgaggagugcacgugcggguucgcgagcaauaagaccaucgagugcgccugccgcgacaacuccuacaccgccaagcggcccuuugucaagcucaacguggagaccgacaccgccgagauccgccugaugugcacggagaccuaccuggauaccccgcggcccaacgacggcagcaucaccgggcccugcggcuccgacggcgauaaggggagcggcgggaucaagggcggguucgugcaccagcgcauggccuccaagaucggccggugguacagccgcacgauguccaagaccaagcggaugggcauggggcucuaugucaaguacgacggcgaccccuggaccgacagugaggcgcuggcccuguccggggugauggugagcauggacgagccgggcugguacuccuucggguucgagaucaaggauaagaagugcgacguccccugcaucggcaucgagauggugcacgacggcgggaagaccacguggcauagcgccgccaccgccaucuacugccucaugggcuccgggcagcugcugugggacaccgugaccggcgucgacauggcgcucuga

SEQ ID NO: 29935 - RNA, 1401 nt, Artificial Sequence; identical to SEQ ID NO: 29073
  derived and/or modified CDS sequence (AUadapt) from InfluenzaB__AGX24099__NA

SEQ ID NO: 29936 - RNA, 1401 nt, Artificial Sequence
  derived and/or modified CDS sequence (AUadapt) from InfluenzaB__AGX24110__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaaugccagcaacgugcaggccgugaaccgcuccgccgccaagggcgucacgcuccugcugcccgagcccgaguggaccuacccgcggcucagcugucccggguccaccuuccagaaggcgcugcugaucagcccccaccgcuucggcgagaccaaggggaacuccgcgccccucaucauccgggagccguuuaucgccugcggccccacggagugcaagcacuucgcccugacccacuaugccgcccagcccggcggguacuacaacggcacccgcgaggaccggaacaagcugcgccaucucaucagcgugaagcuggggaagauccccaccguggagaacuccaucuuccacauggccgccuggagcggcuccgccugucacgacgggaaggaguggacguacgucggcguggacggcccggacaguaacgcgcugcucaagaucaaguacggggaggccuacaccgacaccuaccauuccuacgccaagaacauccugcggacccaggagagcgccugcaacuguaucggcggggacugcuaccugaugaucacggacggccccgccagcggcaucuccgagugucgcuuccucaagauccgggaggggcgcaucaucaaggagaucuuccccaccggccgggugaagcacaccgaggagugcacgugcggguuugcgagcaacaagaccaucgagugcacgugccgcgacaauuccuacaccgccaagcggcccuucgucaagcugaacguggagaccgacaccgccgagauccgccugaugugcaccgagaccuaucucgacaccccgcggcccaacgacggcagcaucacggggcccugcggcuccgauggcgacaaggggagcggcgggaucaagggcggguucgugcaccagcgcauggccuccaagaucggccggugguacagucgcaccauguccaagaccaagcggaugggcauggggcuguacgucaaguacgacggcgaccccuggaccgacagugaggcccuggcgcucuccggggugauggugagcauggacgagccgggcugguacuccuucggguucgagaucaaggauaagaagugcgacguccccugcaucggcaucgagauggugcacgacggcgggaagacgaccuggcauagcgccgccaccgccaucuacugccugaugggcuccgggcagcugcucugggacaccgugacgggcgucgacauggcccuguga

SEQ ID NO: 29937 - RNA, 1401 nt, Artificial Sequence
  derived and/or modified CDS sequence (AUadapt) from InfluenzaB__AGX24121__NA
augcugcccaguaccauccagacccucacgcuguuccugaccuccggcggggugcuccugagccuguacgucuccgccagccucuccuaccugcuguacagugacauccuccugaaguucucccagaccgagaucaccgccccgaucaugccccuggacuacgcgaacgccagcaacgugcaggccgugaaucacuccgccgccaagggcgucacgcuccugcugcccgagcccgaguggaccuacccgcgccucagcugccccggguccaccuuccagaaggcgcugcugaucucgccccaucgguucggcgagaccaaggggaacuccgcgccccucaucauccgcgagccguucaucgccugcggccccacggagugcaagcacuucgcccugacccauuacgccgccaagcccggcggguacuacaacggcacccgggaggaccgcaacaagcugcggcaucucaucagcgugaagcuggggaagauccccaccguggagaacuccaucuuccacauggccgccuggagcggcuccgccugccacgaugggaaggaguggacguacaucggcgucgacggcccggacucgaacgcgcugcucaagaucaaguacggggaggccuauaccgacaccuaccacuccuacgccaagaacauccugcgcacccaggagagcgccugcaauugcaucggcggggacugcuaccugaugaucacggacggccccgccagcggcaucuccgagugucgguuccucaagauccgcgaggggcggaucaucaaggagaucuuccccaccggccgcgugaagcacaccgaggagugcacgugcggguucgcgucgaauaagaccaucgagugcgccugccgggacaacuccuacaccgccaagcgccccuucgugaagcugaaugucgagaccgacaccgccgagauccggcugaugugcacggagaccuaccucgacaccccgcgccccaacgacggcagcaucaccgggcccugugaguccgacggcgacaagggcagcgggggcaucaagggcggguucgugcaccagcggauggccuccaagaucgggcgcugguacagucggacgauguccaagaccaagcgcaugggcaugggccuguacgugaaguacgacggggaccccuggaccgacagcgaggcgcuggcccucuccggcgucauggugagcauggaggagccggggugguauuccuucggcuucgagaucaaggacaagaagugcgacgugcccugcaucgggaucgagaugguccaugacggcggcaagaccacguggcacagcgccgccaccgccaucuacugccugaugggguccggccagcugcucugggacaccgugaccgggguggacauggcgcuguga

SEQ ID NO: 29938 - RNA, 1401 nt, Artificial Sequence
  derived and/or modified CDS sequence (AUadapt) from InfluenzaB__AGX24132__NA
augcugcccaguaccauccagacccucacgcuguuccugaccuccggcggggugcuccugagccuguacgucuccgccagccucuccuaccugcuguauucggacauccuccugaaguucucccgcaccgagaucaccgccccgaucaugccccuggacugcgcgaacgccaguaacgugcaggccgugaaccgguccgccacgaagggcgucacccucccccugcccgagccggaguggaccuacccccgccugagcugccccggguccaccuuucagaaggcccuccugaucagcccccaccgguucggcgagacgaaggggaacuccgcgccgcugaucauccgcgagcccuucaucgccugcggccccaaggaguguaagcacuucgcccucacccacuacgccgcgcagcccggcggguacuacaauggcacccgggaggaccgcaacaagcugcggcaccugaucucggugaagcucgggaagaucccgaccguggagaacuccaucuuucacauggccgccuggagcggcuccgccugccacgacgggcgcgaguggacguacaucggcgucgauggccccgacagcaacgcccugcugaagaucaaguacggggaggcguacaccgauaccuaccacuccuacgccaagaacauccuccggacccaggagagcgccugcaauugcaucggcggggacugcuaccugaugaucacggacggccccgcccugggcaucucggagugucgcuuccucaagauccgggaggggcgcaucaucaaggagaucuuccccaccggccgggugaagcacaccgaggagugcacgugcggguuugccuccaacaagaccaucgagugcgcgugccgcgacaacagcuauaccgccaagcggccguucgugaagcugaacgucgagaccgacaccgccgagauccgccugaugugcacggagaccuaccucgauacgccccggcccaacgacggcuccaucaccgggcccugcgagagcaacggcgacaagggcuccgggggcaucaagggcggguuugugcaccagcgcauggccagcaagaucgggcggugguacucccgcaccaugucgaagaccaagcggaugggcaugggccuguacgugaaguacgauggggacccguggaccgacuccgaggcccuggcgcucagcggcgucaugguguccauggaggagcccgggugguacagcuuuggcuucgagaucaaggacaagaagugcgacgugcccugcaucgggaucgagaugguccacgauggcggcaagaccacguggcacuccgccgccaccgccaucuacugccugauggggagcggccagcugcucugggacaccgugaccggggugaacaugacgcuguga

SEQ ID NO: 29939 - RNA, 1401 nt, Artificial Sequence
  derived and/or modified CDS sequence (AUadapt) from InfluenzaB__AGX24143__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgaucaugccccuggacugugcgaacgccagcaacgugcaggccgugaaccgcuccgccgccaagggcgucacgcuccugcugcccgagcccgaguggaccuacccgcggcucaguugccccggguccaccuuccagaaggcgcugcugaucucgccccaccgcuucggcgagaccaaggggaauuccgcgccccucaucauccgggagccguucaucgccugcggccccacggagugcaagcacuucgcccugacccauuacgccgcccagcccggcggguacuacaacggcacccgcgaggaccggaauaagcugcgccaccucaucagcgugaagcuggggaagauccccaccguggagaacuccaucuuccacauggccgccuggaguggcuccgccugccacgacgggaaggaguggacguacaucggcgucgacggcccggaugggaacgcgcugcucaagaucaaguacggcgaggccuacaccgacaccuaccauagcuacgccaagaacauccugcggacccaggaguccgccugcaacuguaucgggggcgacugcuaccugaugaucacggacggccccgccagcgggaucagugagugccgcuuccucaagauccgggagggccgcaucaucaaggagaucuuccccaccgggcgggugaagcacaccgaggagugcacguguggcuucgcguccaacaagaccaucgagugcgccugccgcgacaauucguacaccgccaagcggcccuucgugaagcugaacgucgagaccgacaccgccgagauccgccugauguguacggagaccuaccucgacaccccgcggcccaacgacggguccaucaccggccccugcgagagugacggcgacaagggguccggcgggaucaagggcggguucgugcaccagcgcauggccagcaagaucggccggugguauucccgcacgaugagcaagaccaagcggaugggcauggggcuguacgugaaguacgacggcgaccccuggaccgauuccgaggcgcuggcccucagcggggucaugguguccauggaggagccgggcugguacagcuucggguucgagaucaaggauaagaagugcgacgugcccugcaucggcaucgagaugguccacgacggcgggaagaccacguggcauuccgccgccaccgccaucuacugccugaugggcagcgggcagcugcucugggacaccgugaccggcguggacauggcgcuguga

SEQ ID NO: 29940 - RNA, 1401 nt, Artificial Sequence; identical to SEQ ID NO: 29073
  derived and/or modified CDS sequence (AUadapt) from InfluenzaB__AGX24154__NA

SEQ ID NO: 29941 - RNA, 1401 nt, Artificial Sequence
  derived and/or modified CDS sequence (AUadapt) from InfluenzaB__AGX24165__NA
augcugcccaguaccauccagacccucacgcuguuccugaccuccggcggggugcuccugagccuguacgucuccgccucgcucuccuaccugcuguacagugacauccuccugaaguucucccagaccgagaucaccgccccgaucaugccccuggacuacgcgaacgccagcaacgugcaggccgugaaucacuccgccgccaagggcgucacgcuccugcugcccgagcccgaguggaccuacccgcgccucucgugccccggguccaccuuccagaaggcgcugcugaucagcccccaucgguucggcgagaccaaggggaacuccgcgccccucaucauccgcgagccguucaucgccugcggccccacggagugcaagcacuucgcccugacccauuacgccgcccagcccggcggguacuacaacggcacccgggaggaccgcaacaagcugcggcaucucaucagcgugaagcuggggaagauccccaccguggagaacuccaucuuccacauggccgccuggucgggcuccgccugccacgaugggaaggaguggacguacaucggcgucgacggcccggacagcaacgcgcugcucaagaucaaguacggggaggccuauaccgacaccuaccacuccuacgccaagaacauccugcgcacccaggagucggccugcaauugcaucggcggggacugcuaccugaugaucacggacggccccgccagcggcaucuccgagugccgguuucucaagauccgcgaggggcggaucaucaaggagaucuuccccaccggccgcgugaagcacaccgaggagugcacgugcggguucgcgagcaauaagaccaucgagugcgccugccgggacaacuccuacaccgccaagcgccccuucgugaagcugaacgucgagaccgauaccgccgagauccggcugaugugcacggagaccuaccucgacaccccgcgccccaacgacggcucgaucaccgggcccugugaguccgacggcgacaagggcagcgggggcaucaagggcggguucgugcaccagcggauggccuccaagaucgggcgcugguacagccggacgauguccaagaccaagcgcaugggcaugggccuguaugugaaguacgacggggaccccuggaccgacucggaggcgcuggcccucaacggcgucaugguguccauggaggagccggggugguauagcuucggcuucgagaucaaggacaagaagugcgacgugcccugcaucgggaucgagaugguccaugacggcggcaagaccacguggcacuccgccgccaccgccaucuacugccugauggggagcggccagcugcucugggacaccgugaccgggguggacauggcgcuguga

SEQ ID NO: 29942 - RNA, 1401 nt, Artificial Sequence; identical to SEQ ID NO: 28686
  derived and/or modified CDS sequence (AUadapt) from InfluenzaB__AGX24176__NA

SEQ ID NO: 29943 - RNA, 1401 nt, Artificial Sequence; identical to SEQ ID NO: 28686
  derived and/or modified CDS sequence (AUadapt) from InfluenzaB__AGX24187__NA

SEQ ID NO: 29944 - RNA, 1401 nt, Artificial Sequence; identical to SEQ ID NO: 28686
  derived and/or modified CDS sequence (AUadapt) from InfluenzaB__AGX24198__NA

SEQ ID NO: 29945 - RNA, 1401 nt, Artificial Sequence; identical to SEQ ID NO: 29260
  derived and/or modified CDS sequence (AUadapt) from InfluenzaB__AGX24231__NA

SEQ ID NO: 29946 - RNA, 1401 nt, Artificial Sequence; identical to SEQ ID NO: 28686
  derived and/or modified CDS sequence (AUadapt) from InfluenzaB__AGX24242__NA

SEQ ID NO: 29947 - RNA, 1401 nt, Artificial Sequence
  derived and/or modified CDS sequence (AUadapt) from InfluenzaB__AGX24275__NA
augcugcccaguaccauccaaacccucacgcuguuccugaccuccggcggggugcuccugagccuguacgucuccgccagccucuccuaucugcuguacagcgacauccuccugaaguucucccagaccgagaucaccgccccgaucaugccccuggauugcgcgaacgccagcaacgugcaggccgugaaccgcuccgccgccaagggcgucacgcuccugcugcccgagcccgaguggaccuauccgcggcucagcugccccggguccaccuuccagaaggcgcugcugaucagcccccaucgcuucggcgagaccaaggggaacuccgcgccccucaucauccgggagccguucaucgccugcggccccacggagugcaagcauuucgcccugacccacuacgccgcccagcccggcggguacuauaacggcacccgcgaggaccggaacaagcugcgccaccucaucagugugaagcuggggaagauccccaccguggagaacuccaucuuccacauggccgccuggagcggcuccgccugccaugacgggaaggaguggacguacaucggcgucgacggcccggacaguaacgcgcugcucaagaucaaguacggggaggccuacaccgacaccuaccauuccuacgccaagaacauccugcggacccaggagagcgccugcaauugcaucggcggggacugcuaccugaugaucacggauggccccgccagcggcaucuccgagugccgcuuccucaagauccgggaggggcgcaucaucaaggagaucuuccccaccggccgggugaagcacaccgaggaguguacgugcggguucgcgagcaaccgcaccaucgagugugccugccgggacaacuccuacaccgccaagcgccccuucgugaagcugaaugucgagaccgacaccgccgagauccggcugaugugcacggagaccuaccucgacaccccgcgccccaaugacggcagcaucaccgggcccugcgaguccgacggcgauaagggcagcgggggcaucaagggcggguucgugcaccagcggauggccuccaagaucgggcgcugguacagccggacgauguccaagacccgccggaugggcaugggccuguaugugaaguacgacggggaccccuggaccgacagugaggcgcuggcccucuccggcgucauggugagcauggaggagccggggugguacuccuucggcuucgagaucaaggacaagaagugugacgugcccugcaucgggaucgagaugguccacgacggcggcaagaccacguggcauagcgccgccaccgccaucuacugccugaugggguccggccagcugcucugggacaccgugaccgggguggacauggcgcuguga

SEQ ID NO: 29948 - RNA, 1401 nt, Artificial Sequence; identical to SEQ ID NO: 29525
  derived and/or modified CDS sequence (AUadapt) from InfluenzaB__AGX24286__NA

SEQ ID NO: 29949 - RNA, 1401 nt, Artificial Sequence
  derived and/or modified CDS sequence (AUadapt) from InfluenzaB__AGX24297__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgaucaugccccuggacugugcgaacgccagcaacgugcaggccgugaaccgcuccgccgccaagggcgucacgcuccugcugcccgagcccgaguggaccuacccgcggcucaguugccccggguccaccuuccagaaggcgcugcugaucagcccccaccgcuuuggcgagacccgggggaacuccgcgccccucaucauccgcgagccguucaucgccugcggccccacggagugcaagcacuuugcccugacccacuacgccgcccagcccggcggguacuacaacggcacccgggaggaucgcaacaagcugcggcaccucaucagcgugaagcuggggaagauccccaccguggagaacuccaucuuucacauggccgccuggagcggcuccgccugccacgacgggaaggaguggacguauaucggcgucgacggcccggacagcaacgcgcugcucaagaucaaguacggggaggccuauaccgacaccuaccacuccuacgccaagaauauccugcgcacccaggagagcgccugcaacugcaucggcggggacuguuaccugaugaucacggacggccccgccagcggcaucuccgagugccgguuccucaagauccgcgaggggcggaucaucaaggagaucuuucccaccggccgcgugaagcacaccgaggagugcacgugcggguucgcgaguaacaagaccaucgagugcgccugccgggacaacuccuauaccgccaagcgccccuucgugaagcugaacgucgagaccgacaccgccgagauccggcugaugugcacggagaccuaccucgauaccccgcgccccaacgacggcagcaucaccgggcccugcgaguccgauggcgacaagggcagcgggggcaucaagggcggguucgugcaccagcggauggccuccaagaucgggcgcugguacagucggacgauguccaagaccaagcgcaugggcaugggccuguacgugaaguacgacggggaccccuggaccgacagugaggcgcuggcccucuccggcgucauggugagcauggaggagccggggugguacuccuucggcuucgagaucaaggauaagaagugcgacgugcccugcaucgggaucgagaugguccacgacggcggcaagaccacguggcauagcgccgccaccgccaucuacugccugaugggguccggccagcugcucugggacaccgugaccgggguggacauggcgcuguga

SEQ ID NO: 29950 - RNA, 1401 nt, Artificial Sequence; identical to SEQ ID NO: 29525
  derived and/or modified CDS sequence (AUadapt) from InfluenzaB__AGX24319__NA

SEQ ID NO: 29951 - RNA, 1401 nt, Artificial Sequence
  derived and/or modified CDS sequence (AUadapt) from InfluenzaB__AGX24330__NA
augcugcccaguaccauccagacccucacgcuguuccugaccuccggcggggugcuccugagccuguacgucuccgccucgcucuccuaccugcuguacagcgauauccuccugaaguucucccagaccgagaucaccgccccgaucaugccccuggacuacgcgaacgccagcaacgugcaggccgugaaccacuccgccgccaagggcgucacgcuccugcugcccgagcccgaguggaccuauccgcgccucucgugccccggguccaccuuccagaaggcgcugcugaucagcccccaccgguucggcgagaccaaggggaacuccgcgccccucaucauccgcgagccguuuaucgccugcggccccacggagugcaagcacuucgcccugacccacuacgccgcccagcccggcggguacuacaauggcacccgggaggaccgcaacaagcugcggcaccucaucagcgugaagcuggggaagauccccaccguggagaacuccaucuuccacauggccgccuggaguggcuccgccugccacgacgggaaggaguggacguacaucggcgucgacggcccggacagcaacgcgcugcucaagaucaaguauggggaggccuacaccgacaccuaccacuccuacgccaagaacauccugcgcacccaggagucggccugcaauugcaucggcggggacugcuaccugaugaucacggacggccccgccagcggcaucuccgagugccgguuucucaagauccgcgaggggcggaucaucaaggagaucuuccccaccggccgcgugaagcacaccgaggagugcacgugcggguucgcgagcaacaagaccaucgagugcacgugucgggacaacuccuacaccgccaagcgccccuucgugaagcugaacgucgagaccgacaccgccgagauccggcugaugugcaccgagaccuaucucgacaccccgcgccccaacgacggcucgaucacggggcccugcgaguccgacggcgacaagggcagcgggggcaucaagggcggguuugugcaccagcggauggccuccaagaucgggcgcugguacagccggaccauguccaagaccaagcgcaugggcaugggccuguacgugaaguacgacggggaccccuggaccgauucggaggcccuggcgcucuccggcgucaugaucagcauggaggagccggggugguacuccuucggcuucgagaucaaggacaagaagugcgacgugcccuguaucgggaucgagauggugcacgacggcggcaagacgaccugguacagcgccgccaccgccaucuacugccugaugggguccggccagcugcucugggacaccgucacggggguggacauggcccuguga

SEQ ID NO: 29952 - RNA, 1401 nt, Artificial Sequence
  derived and/or modified CDS sequence (AUadapt) from InfluenzaB__AGX24341__NA
augcugcccaguaccauccagacccucacgcuguuccugaccuccggcggggugcuccugagccuguacgucuccgccagccucuccuaccugcuguacagugacauccuccugaaguucucccgcaccgagaucaccgccccgaucaugccccuggacugcgcgaacgccagcaaugugcaggccgugaaccgguccgccacgaagggcgucacccuccugcugcccgagcccgaguggaccuacccgcgccucagcugccccggguccaccuuccagaaggcccugcugaucucgccccaccgguuuggcgagacgaaggggaacuccgcgccccucaucauccgcgagccguucaucgccugcggccccaaggagugcaagcacuucgcccugacccauuacgccgcgcagcccggcggguacuacaacggcacccgggaggaccgcaacaagcugcggcaccucaucagugugaagcuggggaagauccccaccguggagaacuccaucuuccacauggccgccuggagcggcuccgccugccacgaugggcgcgaguggacguacaucggcgucgacggcccggacucgaacgcccugcucaagaucaaguacggggaggcguacaccgauaccuaccacuccuacgccaagaacauccugcggacccaggagagcgccugcaauugcaucggcggggacugcuaccugaugaucacggacggccccgccagcggcaucuccgagugucgcuuccucaagauccgggaggggcgcaucaucaaggagaucuuccccaccggccgggugaagcacaccgaggagugcacgugcggguucgccucgaauaagaccaucgagugcgcgugccgcgacaacuccuacaccgccaagcggcccuucgugaagcugaaugucgagaccgacaccgccgagauccgccugaugugcacggagaccuaccucgacaccccgcggcccaacgacggcagcaucaccgggcccugugaguccaacggcgacaagggcagcgggggcaucaagggcggguucgugcaccagcgcauggccuccaagaucgggcggugguacagucgcacgauguccaagaccaagcggaugggcaugggccuguacgugaaguacgacggggaccccuggaccgacagcgaggcccugacccucuccggcgucauggugagcauggaggagccggggugguauuccuucggcuucgagaucaaggacaagaagugcgacgugcccugcaucgggaucgagaugguccaugacggcggcaagacgaccuggcacagcgcggccaccgccaucuacugccugaugggguccggccagcugcucugggacaccgugacgggggugaacaugacccuguga

SEQ ID NO: 29953 - RNA, 1401 nt, Artificial Sequence
  derived and/or modified CDS sequence (AUadapt) from InfluenzaB__AGX24352__NA
augcugcccaguaccauccagacccucacgcuguuccugaccuccggcggggugcuccugagccuguacgucuccgccucgcucuccuaccugcuguacagugacauccuccugaaguucucccgcaccgagaucaccgccccgaucaugccccuggacugcgcgaacgccagcaacgugcaggccgugaaucgguccgccacgaagggcgucacccuccugcugcccgagcccgaguggaccuacccgcgccucucgugccccggguccaccuuccagaaggcccugcugaucagcccccaccgguuuggcgagacgaaggggaacuccgcgccccucaucauccgcgagccguucaucgccugcggccccaaggagugcaagcacuucgcccugacccacuaugccgcgcagcccggcggguacuacaacggcacccgggaggaccgcaacaagcugcggcaccucaucagugugaagcuggggaagauccccaccguggagaacuccaucuuccacauggccgccuggucgggcuccgccugccacgacgggcgcgaguggacguauaucggcgucgacggcccggacaacaacgcccugcucaagaucaaguacggggaggcguacaccgauaccuaccacagcuacgccaagaacauccugcggacccaggaguccgccugcaacuguaucggcggggacugcuaccugaugaucacggacggccccgccucgggcaucagcgagugucgcuuccucaagauccgggaggggcgcaucaucaaggagaucuuccccaccggccgggugaagcacaccgaggagugcacgugcggguucgccuccaacaagaccaucgagugugcgugccgcgacaacagcuacaccgccaagcggcccuucgugaagcugaaugucgagaccgacaccgccgagauccgccugaugugcacggagaccuaccucgacaccccgcggcccaacgacggcuccaucaccgggcccugcgagaguaacggcgacaagggcuccgggggcaucaagggcggguucgugcaccagcgcauggccagcaagaucgggcggugguacucccgcacgaugaguaagaccaagcggaugggcaugggccuguacgugaaguacgacggggaccccuggaccgacuccgaggcccuggcgcucucgggcgucaugguguccauggaggagccggggugguacaguuucggcuucgagaucaaggacaagaagugcgacgugcccugcaucgggaucgagaugguccaugacggcggcaagaccacguggcacuccgccgccaccgccaucuacugccugauggggagcggccagcugcucugggacaccgugaccggggugaacaugacgcuguga

SEQ ID NO: 29954 - RNA, 1401 nt, Artificial Sequence; identical to SEQ ID NO: 29949
  derived and/or modified CDS sequence (AUadapt) from InfluenzaB__AGX24363__NA

SEQ ID NO: 29955 - RNA, 1401 nt, Artificial Sequence; identical to SEQ ID NO: 29953
  derived and/or modified CDS sequence (AUadapt) from InfluenzaB__AGX24374__NA

SEQ ID NO: 29956 - RNA, 1401 nt, Artificial Sequence
  derived and/or modified CDS sequence (AUadapt) from InfluenzaB__AGX24385__NA
augcugcccaguaccauccagacccucacgcuguuccugaccuccggcggggugcuccugagccuguacgucuccgccagccucuccuaccugcuguauucggacauccuccugaaguucucccgcaccgagaucaccgccccgacgaugccccuggacugcgcgaacgccaguaacgugcaggccgugaaccgguccgccaccaagggcgucacccuccugcugcccgagcccgaguggaccuacccgcgccucagcugccccggguccacguuucagaaggcccugcugaucagcccccaccgguucggcgagaccaaggggaacuccgcgccccucaucauccgcgagccguucaucgccugcggccccaaggaguguaagcacuucgcccugacccacuacgccgcgcagcccggcggguacuacaauggcacccgggaggaccgcaacaagcugcggcaccucaucucggugaagcuggggaagauccccacgguggagaacuccaucuuucacauggccgccuggagcggcuccgccugccacgacgggcgcgaguggaccuacaucggcgucgauggcccggacagcaacgcccugcucaagaucaaguacggggaggcguacaccgauaccuaccacuccuacgccaagaacauccugcggacgcaggagagcgccugcaauugcaucggcggggacugcuaccugaugaucaccgacggccccgccucgggcaucuccgagugucgcuuccucaagauccgggaggggcgcaucaucaaggagaucuuccccaccggccgggugaagcacaccgaggagugcacgugcggguuugccagcaacaagaccaucgagugcgcgugccgcgacaacuccuauaccgccaagcggcccuucgugaagcugaacgucgagaccgacacggccgagauccgccugaugugcaccgagaccuaccucgauaccccgcggcccaacgacggcagcaucacggggcccugcgaguccaacggcgacaagggcagugggggcaucaagggcggguucgugcaccagcgcauggccuccaagaucgggcggugguacucgcgcaccauguccaagaccaagcggaugggcaugggccuguacgugaaguacgauggggaccccuggaccgacagcgaggcccuggcgcucuccggcgucauggugagcauggaggagccggggugguacuccuuuggcuucgagaucaaggacaagaagugcgacgugcccugcaucgggaucgagaugguccacgauggcggcaagacgaccuggcacagcgccgccaccgccaucuacugccugaugggguccggccagcugcucugggacaccgugacgggggugaacaugacccuguga

SEQ ID NO: 29957 - RNA, 1401 nt, Artificial Sequence
  derived and/or modified CDS sequence (AUadapt) from InfluenzaB__AGX24396__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgaucaugccccuggacugugcgaacgccagcaacgugcaggccgugaaccgcuccgccgccaagggcgucacgcuccugcugcccgagcccgaguggaccuacccgcggcucaguugccccggguccaccuuccagaaggcgcugcugaucagcccccaccgcuuuggcgagaccaaggggaacuccgcgccccucaucauccgggagccguucaucgccugcggccccacggagugcaagcacuuugcccugacccacuacgccgcccagcccggcggguacuacaacggcacccgcgaggaucggaacaagcugcgccaccucaucagcgugaagcuggggaagauccccaccguggagaacuccaucuuucacauggccgccuggagcggcuccgccugccacgacgggaaggaguggacguauaucggcgucgacggcccggacucgaacgcgcugcucaagaucaaguacggggaggccuauaccgacaccuaccacuccuacgccaagaauauccugcggacccaggagagcgccugcaacugcaucggcggggacuguuaccugaugaucacggacggccccgccagcggcaucuccgagugccgcuuccucaagauccgggaggggcgcaucaucaaggagaucuuucccaccggccgggugaagcacaccgaggagugcacgugcggguucgcgaguaacaagaccaucgagugcgccugccgcgacaaccgguauaccgccaagcgccccuucgugaagcugaacgucgagaccgacaccgccgagauccggcugaugugcacggagaccuaccucgauaccccgcgccccaacgacggcuccaucaccgggcccugcgagagcgauggcgacaagggcuccgggggcaucaagggcggguucgugcaccagcggauggccagcaagaucgggcgcugguacucccggacgaugaguaagaccaagcgcaugggcaugggccuguacgugaaguacgacggggaccccuggaccgacuccggcgcgcuggcccucaguggggucaugguguccaucgaggagccgggcugguacagcuucggguucgagaucaaggauaagaagugcgacgugcccugcaucggcaucgagaugguccacgacggcgggaagaccacguggcauuccgccgccaccgccaucuacugccugaugggcagcgggcagcugcucugggacaccgugaccggcguggacauggcgcuguga

SEQ ID NO: 29958 - RNA, 1401 nt, Artificial Sequence; identical to SEQ ID NO: 29957
  derived and/or modified CDS sequence (AUadapt) from InfluenzaB__AGX24407__NA

SEQ ID NO: 29959 - RNA, 1401 nt, Artificial Sequence; identical to SEQ ID NO: 28686
  derived and/or modified CDS sequence (AUadapt) from InfluenzaB__AGX24418__NA

SEQ ID NO: 29960 - RNA, 1401 nt, Artificial Sequence; identical to SEQ ID NO: 28901
  derived and/or modified CDS sequence (AUadapt) from InfluenzaB__AGX24429__NA

SEQ ID NO: 29961 - RNA, 1401 nt, Artificial Sequence
  derived and/or modified CDS sequence (AUadapt) from InfluenzaB__AGX24440__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaaugccucgaacgugcaggccgugaaccgcuccgccgccaagggcgucacgcuccugcugcccgagcccgaguggaccuacccgcggcucagcugucccggguccaccuuccagaaggcgcugcugaucagcccccaccgcuucggcgagaccaaggggaacuccgcgccccucaucauccgggagccguucaucgccuguggcacgaccgagugcaagcacuucgcccugacccacuacgccgcccagcccggcggguauuacaacggcacccgcgaggaccggaacaagcugcgccaccucaucagugugaagcuggggaagauccccacgguggagaacuccaucuuccacauggccgccuggagcggcuccgccugccaugacgggaaggaguggaccuacaucggcgucgacggccccgacucgaacgcgcugcucaagaucaaguauggggaggccuacaccgacaccuaccacuccuacgccaagaauauccugcggacgcaggagagcgccugcaacugcaucggcggggacuguuaccugaugaucaccgacggcccggccagcggcaucuccgagugccgcuuccucaagauccgggaggggcgcaucaucaaggagaucuuucccaccggccgggugaagcacaccgaggagugcacgugcggguucgcgagcaacaagaccaucgagugugccugccgcgacaaccgguacaccgccaagcgccccuucgugaagcugaaugucgagaccgacacggccgagauccggcugaugugcaccgagaccuaccucgacacgccccgcccgaacgauggcuccaucaccgggcccugcgagagcgacggcgacaagggcuccgggggcaucaagggcggguucgugcaucagcggauggccucgaagaucgggcgcugguacucccggaccaugagcaagaccaagcgcaugggcaugggccuguacgugaaguacgacggggaucccuggaccgacuccggcgcgcuggcccucagcggggucaugguguccaucgaggagcccggcugguacagcuucggguuugagaucaaggacaagaagugcgacgugccgugcaucggcaucgagaugguccacgauggcgggaagacgaccuggcacuccgccgccaccaccaucuacugccugaugggcagcgggcagcugcucugggacacggugaccggcguggacauggcccuguga

SEQ ID NO: 29962 - RNA, 1401 nt, Artificial Sequence; identical to SEQ ID NO: 29525
  derived and/or modified CDS sequence (AUadapt) from InfluenzaB__AGX24451__NA

SEQ ID NO: 29963 - RNA, 1401 nt, Artificial Sequence
  derived and/or modified CDS sequence (AUadapt) from InfluenzaB__AGX24462__NA
augcugcccaguaccauccagacccucacgcuguuccugaccuccggcggggugcuccugagccuguacgucuccgccagccucuccuaccugcuguacagugacauccuccugaaguucucccagaccgagaucaccgccccgaucaugccccuggacuacgcgaacgccagcaacgugcaggccgugaaucacuccgccgccaagggcgucacgcuccugcugcccgagcccgaguggaccuacccgcgccucagcugccccggguccaccuuccagaaggcgcugcugaucucgccccaucgguucggcgagaccaaggggaacuccgcgccccucaucauccgcgagccguucaucgccugcggccccacggagugcaagcacuucgcccugacccauuacgccgcccagcccggcggguacuacaacggcacccgggaggaccgcaacaagcugcggcaucucaucagcgugaagcuggggaagauccccaccguggagaacuccaucuuccacauggccgccuggagcggcuccgccugccacgaugggaaggaguggacguacaucggcgucgacggcccggacucgaacgcgcugcucaagaucaaguacggggaggccuauaccgacaccuaccacuccuacgccaagaacauccugcgcacccaggagagcgccugcaauugcaucggcggggacugcuaccugaugaucacggacggccccgccagcggcaucuccgagugucgguuccucaagauccgcgaggggcggaucaucaaggagaucuuccccaccggccgcgugaagcacaccgaggagugcacgugcggguucgcgucgaauaagaccaucgagugcgccugccgggacaacuccuacaccgccaagcgccccuucgugaagcugaaugucgagaccgacaccgccgagauccggcugaugugcacggagaccuaccucgacaccccgcgccccaacgacggcagcaucaccgggcccugugaguccgacggcgacaagggcagcgggggcaucaagggcggguucgugcaccagcggauggccuccaagaucgggcgcugguacagucggacgauguccaagaccaagcgcaugggcaugggccuguacgugaaguacgacggggaccccuggaccgacagcgaggcgcuggcccucuccggcgucaugaucagcauggaggagccggggugguauuccuucggcuucgagaucaaggacaagaagugcgacgugcccugcaucgggaucgagauggugcaugacggcggcaagaccacguggcacagcgccgccaccgccaucuacugccugaugggguccggccagcugcucugggacaccgucaccgggguggacauggcgcuguga

SEQ ID NO: 29964 - RNA, 1401 nt, Artificial Sequence; identical to SEQ ID NO: 29963
  derived and/or modified CDS sequence (AUadapt) from InfluenzaB__AGX24473__NA

SEQ ID NO: 29965 - RNA, 1401 nt, Artificial Sequence
  derived and/or modified CDS sequence (AUadapt) from InfluenzaB__AGX24484__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgaucaugccccuggauugcgcgaacgccagcaacgugcaggccgugaaccgcuccgccgccaagggcgucacgcuccugcugcccgagcccgaguggaccuauccgcggcucagcugccccggguccaccuuccagaaggcgcugcugaucagcccccaucgcuucggcgagaccaaggggaacuccgcgccccucaucauccgggagccguucaucgccugcggccccacggagugcaagcauuucgcccugacccacuacgccgcccagcccggcggguacuauaacggcacccgcgaggaccggaacaagcugcgccaccucaucagugugaagcuggggaagauccccaccguggagaacuccaucuuccacauggccgccuggagcggcuccgccugccaugacgggaaggaguggacguacaucggcgucgacggcccggacaguaacgcgcugcucaagaucaaguacggggaggccuacaccgacaccuaccauuccuacgccaagaacauccugcggacccaggagagcgccugcaauugcaucggcggggacugcuaccugaugaucacggauggccccgccagcggcaucuccgagugccgcuuccucaagauccgggaggggcgcaucaucaaggagaucuuccccaccggccgggugaagcacaccgaggaguguacgugcggguucgcgagcaacaagaccaucgagugugccugccgcgacaacggcuacaccgccaagcggcccuucgugaagcugaaugucgagaccgacaccgccgagauccgccugaugugcacggagaccuaccucgacaccccgcggcccaaugacggguccaucaccggccccugcgagagcgacggcgauaagggguccggcgggaucaagggcggguucgugcaccagcgcauggccagcaagaucggccggugguacucccgcacgaugagcaagacccggcgcaugggcauggggcuguaugugaaguacgacggcgaccccuggaccgacuccgaggcgcuggcccucaguggggucaugguguccauggaggagccgggcugguacagcuucggguucgagaucaaggacaagaagugugacgugcccugcaucggcaucgagaugguccacgacggcgggaagaccacguggcauuccgccgccaccgccaucuacugccugaugggcagcgggcagcugcucugggacaccgugaccggcguggacauggcgcuguga

SEQ ID NO: 29966 - RNA, 1401 nt, Artificial Sequence
  derived and/or modified CDS sequence (AUadapt) from InfluenzaB__AGX24495__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgaucaugccccuggacugugcgaacgccagcaacguccagguggugaaccgcuccgccgccaagggcgugacgcuccugcugcccgagcccgaguggaccuacccgcggcucaguugccccggguccaccuuccagaaggcccugcugaucagcccccaccgcuucggcgagaccaaggggaauuccgcgccccucaucauccgggagccguucaucgccugcggccccacggagugcaagcacuucgcccugacccauuacgccgcgcagcccggcggguacuacaacggcacccgcgaggaccggaauaagcugcgccaccucaucagcgugaagcuggggaagauccccaccgucgagaacuccaucuuccacauggccgccuggaguggcuccgccugccacgacgggaaggaguggacguacaucggcguggacggcccggauagcaacgcccugcucaagaucaaguacggggaggcguacaccgacaccuaucacuccuacgccaagaacauccugcggacccaggagagcgccugcaauugcaucggcggggacugcuaccugaugaucacggacggccccgccaguggcaucuccgagugccgcuuccucaagauccgggaggggcgcaucaucaaggagaucuuccccaccggccgggugaagcacaccgaggagugcacguguggguucgccagcaacaagaccaucgagugcgcgugccgcgauaacuccuacaccgccaagcggcccuucgucaagcugaacguggagaccgacaccgccgagauccgccugauguguacggagaccuaccucgacaccccgcggcccaacgacggcagcaucaccgggcccugugaguccgacggcgacaagggcagcgggggcaucaagggcggguucgugcaccagcgcauggccuccaagaucgggcggugguauagccgcacgauguccaagacccggcgcaugggcaugggccuguacgucaaguacgacggggaccccuggaccgauagcgaggcccuggcgcucuccggcgugauggugagcauggaggagccggggugguacuccuucggcuucgagaucaaggauaagaagugcgacguccccugcaucgggaucgagauggugcacgacggcggcaagaccacguggcauagcgccgccaccgccaucuacugccugaugggguccggccagcugcucugggacaccgugaccggggucgacauggcccuguga

SEQ ID NO: 29967 - RNA, 1401 nt, Artificial Sequence; identical to SEQ ID NO: 29525
  derived and/or modified CDS sequence (AUadapt) from InfluenzaB__AGX24506__NA

SEQ ID NO: 29968 - RNA, 1401 nt, Artificial Sequence
  derived and/or modified CDS sequence (AUadapt) from InfluenzaB__AGX24517__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaaugccagcaacgugcaggccgugaaccacuccgccgccaagggcgucacgcuccugcugcccgagcccgaguggaccuacccgcgccucaguugccccggguccaccuuccagaaggcgcugcugaucucgccccaccgguucggcgagaccaaggggaacuccgcgccccucaucauccgcgagccguuuaucgccugcggccccacggagugcaagcacuucgcccugacccacuaugccgcccagcccggcggguacuacaacggcacccgggaggaccgcaacaagcugcggcaucucaucagcgugaagcuggggaagauccccaccguggagaacuccaucuuccacauggccgccuggagcggcuccgccugccaugacgggaaggaguggacguacaucggcgucgacggcccggacagcaaugcgcugcucaagaucaaguacggggaggccuacaccgacaccuaccacuccuaugccaagaacauccugcgcacccaggagagcgccugcaacugcaucggcggggacuguuaccugaugaucacggacggccccgccagcggcguguccgagugccgguuccucaagauccgcgaggggcggaucaucaaggagaucuuucccaccggccgcgugaagcacaccgaggagugcacgugcggguucgcgucgaauaagaccaucgagugcgccugccgggacaacuccuacaccgccaagcgccccuucgucaagcugaauguggagaccgacaccgccgagauccggcugaugugcacggagaccuaccucgacaccccgcgccccaacgauggcagcaucaccgggcccugcgaguccgacggcgacaagggcagcgggggcaucaagggcggguuugugcaccagcggauggccuccaagaucgggcgcugguacagccggacgauguccaagaccaagcgcaugggcaugggccuguacgucaaguacgacggggaucccuggaccgacagcgaggcgcuggcccucuccggcgugauggugagcauggaggagccggggugguacuccuucggcuuugagaucaaggacaagaagugcgacguccccugcaucgggaucgagauggugcacgauggcggcaagaccacguggcacagcgccgccaccgccaucuacugccugaugggguccggccagcugcucugggacaccgugaccggggucgacauggcgcuguga

SEQ ID NO: 29969 - RNA, 1401 nt, Artificial Sequence; identical to SEQ ID NO: 29525
  derived and/or modified CDS sequence (AUadapt) from InfluenzaB__AGX24528__NA

SEQ ID NO: 29970 - RNA, 1401 nt, Artificial Sequence; identical to SEQ ID NO: 29953
  derived and/or modified CDS sequence (AUadapt) from InfluenzaB__AGX24539__NA

SEQ ID NO: 29971 - RNA, 1401 nt, Artificial Sequence
  derived and/or modified CDS sequence (AUadapt) from InfluenzaB__AGX24550__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaacgccaguaacgugcaggccgugaaccgcuccgccgccaagggcgucacgcuccugauccccgagcccgaguggaccuacccgcggcugagcugccccggguccaccuuucagaaggcgcuccugaucagcccccaccgcuucggcgagaccaaggggaacuccgcgccccugaucauccgggagccguucaucgccugcggccccacggaguguaagcacuucgcccucacccacuacgccgcccagcccggcggguacuacaauggcacccgcgaggaccggaacaagcugcgccaccugaucagcgugaagcucgggaagauccccaccguggagaacuccaucuuucacauggccgccuggagcggcuccgccugccacgacgggaaggaguggacguacaucggcgucgauggcccggacucgaacgcgcugcugaagaucaaguacggggaggccuacaccgauaccuaccacuccuacgccaagaacauccuccggacccaggagagcgccugcaauugcaucggcggggacugcuaccugaugaucacggacggccccgccagcggcaucuccgagugucgcuuccugaagauccgggaggggcgcaucaucaaggagaucuuccccaccggccgggugaagcacaccgaggagugcacgugcggguuugcgagcaacaagaccaucgagugcgccugccgcgacaacuccuauaccgccaagcggcccuucgugaagcucaacgucgagaccgacaccgccgagauccgccugaugugcacggagaccuaccuggauaccccgcggcccaacgacggcagcaucaccgggcccugcgaguccgacggcgacaagggcagugggggcaucaagggcggguucgugcaccagcgcauggccuccaagaucgggcggugguacagccgcacgauguccaagaccaagcggaugggcaugggccucuacgugaaguacgauggggaccccuggaccgacagcgaggcgcuggcccuguccggcgucauggugagcauggaggagccggggugguacuccuuuggcuucgagaucaaggacaagaagugcgacgugcccugcaucgggaucgagaugguccacgauggcggcaagaccacguggcacagcgccgccaccgccaucuacugccucaugggguccggccagcugcugugggacaccgugaccgggguggacauggcgcucuga

SEQ ID NO: 29972 - RNA, 1401 nt, Artificial Sequence; identical to SEQ ID NO: 29963
  derived and/or modified CDS sequence (AUadapt) from InfluenzaB__AGX24561__NA

SEQ ID NO: 29973 - RNA, 1401 nt, Artificial Sequence; identical to SEQ ID NO: 28686
  derived and/or modified CDS sequence (AUadapt) from InfluenzaB__AGX24572__NA

SEQ ID NO: 29974 - RNA, 1401 nt, Artificial Sequence
  derived and/or modified CDS sequence (AUadapt) from InfluenzaB__AGX24583__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgaucaugccccuggauugcgcgaacgccagcaacgugcaggccgugaaccgcuccgccgccaagggcgucacgcuccugcugcccgagcccgaguggaccuauccgcggcucagcugccccggguccaccuuccagaaggcgcugcugaucagcccccaucgcuucggcgagaccaaggggaacuccgcgccccucaucauccgggagccguucaucgccugcggccccacggagugcaagcauuucgcccugacccacuacgccgcccagcccggcggguacuauaacggcacccgcgaggaccggaacaagcugcgccaccucaucagugugaagcuggggaagauccccaccguggagaacuccaucuuccacauggccgccuggagcggcuccgccugccaugacgggaaggaguggacguacaucggcgucgacggcccggacaguaacgcgcugcucaagaucaaguacggggaggccuacaccgacaccuaccauuccuacgccaagaacauccugcggacccaggagagcgccugcaauugcaucggcggggacugcuaccugaugaucacggauggccccgccagcggcaucuccgagugccgcuuccucaagauccgggaggggcgcaucaucaaggagaucuuccccaccggccgggugaagcacaccgaggaguguacgugcggguucgcgagcaacaagaccaucgagugugccugccgcgacaacuccuacaccgccaagcggcccuucgugaagcugaaugucgagaccgacaccgccgagauccgccugaugugcacggagaccuaccucgacaccccgcggcccaaugacggcagcaucaccgggcccugcgaguccgacggcgauaagggcagcgggggcaucaagggcggguucgugcaccagcgcauggccuccaagaucgggcggugguacagccgcacgauguccaagacccggcgcaugggcaugggccuguaugugaaguacgacggggaccccuggaccgacaguggcgcgcuggcccucuccggggucauggugagcaucgaggagccgggcugguacuccuucggguucgagaucaaggacaagaagugugacgugcccugcaucggcaucgagaugguccacgacggcgggaagaccacguggcauagcgccgccaccgccaucuacugccugaugggcuccgggcagcugcucugggacaccgugaccggcguggacauggcgcuguga

SEQ ID NO: 29975 - RNA, 1401 nt, Artificial Sequence; identical to SEQ ID NO: 29525
  derived and/or modified CDS sequence (AUadapt) from InfluenzaB__AGX24594__NA

SEQ ID NO: 29976 - RNA, 1401 nt, Artificial Sequence; identical to SEQ ID NO: 29525
  derived and/or modified CDS sequence (AUadapt) from InfluenzaB__AGX24605__NA

SEQ ID NO: 29977 - RNA, 1401 nt, Artificial Sequence; identical to SEQ ID NO: 29525
  derived and/or modified CDS sequence (AUadapt) from InfluenzaB__AGX24616__NA

SEQ ID NO: 29978 - RNA, 1401 nt, Artificial Sequence; identical to SEQ ID NO: 29949
  derived and/or modified CDS sequence (AUadapt) from InfluenzaB__AGX24627__NA

SEQ ID NO: 29979 - RNA, 1401 nt, Artificial Sequence; identical to SEQ ID NO: 29525
  derived and/or modified CDS sequence (AUadapt) from InfluenzaB__AGX24638__NA

SEQ ID NO: 29980 - RNA, 1401 nt, Artificial Sequence
  derived and/or modified CDS sequence (AUadapt) from InfluenzaB__AGX24660__NA
augcugcccaguaccauccagacccucacgcuguuccugaccuccggcggggugcuccugagccuguacgucuccgccagccucuccuaccugcuguacagugacauccuccugaaguucucccgcaccgagaucaccgccccgaucaugccccuggacugcgcgaacgccagcaaugugcaggccgugaaccgguccgccacgaagggcgucacccuccugcugcccgagcccgaguggaccuacccgcgccucagcugccccggguccaccuuccagaaggcccugcugaucagcccccaccgguuuggcgagacgaaggggaacuccgcgccccucaucauccgcgagccguucaucgccugcggccccaaggagugcaagcacuucgcccugaccuauuacgccgcgcagcccggcggguacuacaacggcacccgggaggaccgcaacaagcugcggcaccucaucagugugaagcuggggaagauccccaccguggagaacuccaucuuccacauggccgccuggagcggcuccgccugccacgaugggcgcgaguggacguacaucggcgucgacggcccggacagcaacgcccugcucaagaucaaguacggggaggcguacaccgauaccuaccacuccuacgccaagaacauccugcggacccaggagagcgccugcaauugcaucggcggggacugcuaccugaugaucacggacggccccgccucgggcaucuccgagugucgcuuccucaagauccgggaggggcgcaucaucaaggagaucuuccccaccggccgggugaagcacaccgaggagugcacgugcggguucgccagcaauaagaccaucgagugcgcgugccgcgacaacuccuacaccgccaagcggcccuucgugaagcugaaugucgagaccgacaccgccgagauccgccugaugugcacggagaccuaccucgacaccccgcggcccaacgacggcagcaucaccgggcccugugaguccaacggcgacaagggcagcgggggcaucaagggcggguucgugcaccagcgcauggccuccaagaucgggcggugguacagucgcacgauguccaagaccaagcggaugggcaugggccuguacgugaaguacgacggggaccccuggaccgacagcgaggcccuggcgcucuccggcgucauggugagcauggaggagccggggugguauuccuucggcuucgagaucaaggacaagaagugcgacgugcccugcaucgggaucgagaugguccaugacggcggcaagaccacguggcacagcgccgccaccgccaucuacugccugaugggguccggccagcugcucugggacaccgugaccggggugaacaugacgcuguga

SEQ ID NO: 29981 - RNA, 1401 nt, Artificial Sequence
  derived and/or modified CDS sequence (AUadapt) from InfluenzaB__AGX24671__NA
augcugcccaguaccauccagacccucacgcuguuccugaccuccggcggggugcuccugcugcucuacgucagcgccucccugagcuaccugcucuauuccgacauccugcugaaguucagccagaccgagaucaccgccccgaucaugccccucgacugcgcgaacgccuccaaugugcaggccgugaaccgcucggccgccaagggcgucacgcugcugcuccccgagcccgaguggaccuacccgcggcuguccugccccgggagcaccuuucagaaggcgcugcucaucagcccccaccgcuucggcgagaccaaggggaacuccgcgccccugaucauccgggagccguucaucgccugcggccccacggaguguaagcacuucgcccugacccacuacgccgcccagcccggcggguacuacaauggcacccgcgaggaccggaacaagcuccgccaccugaucuccgugaagcuggggaagauccccaccguggagaacagcaucuuucacauggccgccugguccggcagcgccugccacgacgggaaggaguggacguacaucggcgucgauggcccggacuccaacgcgcuccugaagaucaaguacggggaggccuacaccgacaccuaucacucguacgccaagaacauccugcggacccaggaguccgccugcaacuguaucggcggggacugcuaccucaugaucacggacggccccgccagcggcaucagcgagugucgcuuccugaagauccgggaggggcgcaucaucaaggagaucuuccccaccggccgggugaagcacaccgaggagugcacgugcggguuugcguccaacaagaccaucgagugcgccugccgcgacaacagcuauaccgccaagcggcccuucgugaagcugaacgucgagaccgacaccgccgagauccgccucaugugcacggagaccuaccuggauaccccgcggcccaacgacggcuccaucaccgggcccugcgagagcgacggcgacaagggcuccgggggcaucaagggcggguuugugcaccagcgcauggccucgaagaucgggcggugguacucccgcacgaugagcaagaccaagcggaugggcaugggccuguacgugaaguacgauggggaccccuggaccgacuccgaggcgcucgcccugagcggcgucaugguguccauggaggagccggggugguacagcuuuggcuucgagaucaaggacaagaagugcgacauccccugcaucgggaucgagauggugcacgauggcggcaagaccacguggcacuccgccgccaccgccaucuacugccugauggggagcggccagcuccugugggacaccgucaccgggguggacauggcgcuguga

SEQ ID NO: 29982 - RNA, 1401 nt, Artificial Sequence
  derived and/or modified CDS sequence (AUadapt) from InfluenzaB__AGX24682__NA
augcugcccaguaccauccagacccucacgcuguuccugaccuccggcggggugcuccugagccuguacgucuccgccagccucuccuaccugcuguacagugacauccuccugaaguucucccgcaccgagaucaccgccccgaucaugccccuggacugcgcgaacgccagcaaugugcaggccgugaaccgguccgccacgaagggcgucacccuccugcugcccgagcccgaguggaccuacccgcgccucagcugccccggguccaccuuccagaaggcccugcugaucagcccccaccgguuuggcgagacgaaggggaacuccgcgccccucaucauccgcgagccguucaucgccugcggccccaaggagugcaagcacuucgcccugacccauuacgccgcgcagcccggcggguacuacaacggcacccgggaggaccgcaacaagcugcggcaccucaucagugugaagcuggggaagauccccaccguggagaacuccaucuuccacauggccgccuggagcggcuccgccugccacgaugggcgcgaguggacguacaucggcgucgacggcccggacagcaacgcccugcucaagaucaaguacggggaggcguacaccgauaccuaccacuccuacgccaagaacauccugcggacccaggagagcgccugcaauugcaucggcggggacugcuaccugaugaucacggacggccccgccucgggcaucuccgagugucgcuuccucaagauccgggaggggcgcaucaucaaggagaucuuccccaccggccgggugaagcacaccgaggagugcacgugcggguucgccagcaauaagaccaucgagugcgcgugccgcgacaacuccuacaccgccaagcggcccuucgugaagcugaaugucgagaccgacaccgccgagauccgccugaugugcacggagaccuaccucgacaccccgcggcccaacgacggcagcaucaccgggcccugugaguccaacggcgacaagggcagcgggggcaucaagggcggguucgugcaccagcgcauggccuccaagaucgggcggugguacagucgcacgauguccaagaccaagcggaugggcaugggccuguacgugaaguacgacggggaccccuggaccgacagcgaggcccugguccucuccggcgugauggugagcauggaggagccggggugguauuccuucggcuucgagaucaaggacaagaagugcgacguccccugcaucgggaucgagauggugcaugacggcggcaagaccacguggcacagcgcggccaccgccaucuacugccugaugggguccggccagcugcucugggacaccgugaccggggucaacaugacgcuguga

SEQ ID NO: 29983 - RNA, 1401 nt, Artificial Sequence; identical to SEQ ID NO: 29525
  derived and/or modified CDS sequence (AUadapt) from InfluenzaB__AGX24693__NA

SEQ ID NO: 29984 - RNA, 1401 nt, Artificial Sequence; identical to SEQ ID NO: 29525
  derived and/or modified CDS sequence (AUadapt) from InfluenzaB__AGX24704__NA

SEQ ID NO: 29985 - RNA, 1401 nt, Artificial Sequence; identical to SEQ ID NO: 29525
  derived and/or modified CDS sequence (AUadapt) from InfluenzaB__AGX24715__NA

SEQ ID NO: 29986 - RNA, 1401 nt, Artificial Sequence
  derived and/or modified CDS sequence (AUadapt) from InfluenzaB__AGX24737__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgaucaugccccuggacugugcgaacgccagcaacgugcaggccgugaaccgcuccgccgccaagggcgucacgcuccugcugcccgagcccgaguggaccuacccgcggcucaguugccccggguccaccuuccagaaggcgcugcugaucucgccccaccgcuucggcgagaccaaggggaauuccgcgccccucaucauccgggagccguucaucgccugcggcacgaccgagugcaagcacuucgcccugacccauuacgccgcccagcccggcggguacuacaacggcacccgcgaggaccggaauaagcugcgccaccucaucagcgugaagcuggggaagauccccacgguggagaacuccaucuuccacauggccgccuggaguggcuccgccugccacgacgggaaggaguggaccuacaucggcgucgacggccccgauagcaacgcgcugcucaagaucaaguacggggaggccuacaccgacaccuaucacuccuacgccaagaacauccugcggacgcaggagagcgccugcaauugcaucggcggggacugcuaccugaugaucaccgacggcccggccaguggcaucuccgagugccgcuuccucaagauccgggaggggcgcaucaucaaggagaucuuccccaccggccgggugaagcacaccgaggagugcacguguggguucgcgucgaacaagaccaucgagugcgccugccgcgauaaccgguacaccgccaagcgccccuucgugaagcugaacgucgagaccgacacggccgagauccggcugauguguaccgagaccuaccucgacacgccccgcccgaacgacggcuccaucaccgggcccugcgagagugacggcgacaagggcuccgggggcaucaagggcggguucgugcaccagcggauggccagcaagaucgggcgcugguauucccggaccaugagcaagaccaagcgcaugggcaugggccuguacgugaaguacgacggggaccccuggaccgauuccggcgcgcuggcccucagcggggucaugguguccaucgaggagcccggcugguacagcuucggguucgagaucaaggauaagaagugcgacgugccgugcaucggcaucgagaugguccacgacggcgggaagacgaccuggcauuccgccgccaccgccaucuacugccugaugggcagcgggcagcugcucugggacaccgugacgggcguggacauggcgcuguga

SEQ ID NO: 29987 - RNA, 1401 nt, Artificial Sequence
  derived and/or modified CDS sequence (AUadapt) from InfluenzaB__AGX24748__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgaucaugccccuggacugugcgaacgccagcaacgugcaggccgugaaccgcuccgccgccaagggcgucacgcuccugcugcccgagcccgaguggaccuacccgcggcucaguugccccggguccaccuuccagaaggcgcugcugaucagcccccaccgcuucggcgagaccaaggggaauuccgcgccccucaucauccgggagccguucaucgccugcggccccacggagugcaagcacuucgcccugacccauuacgccgcccagcccggccgcuacuacaacgggacccgggaggaccgcaauaagcugcggcaccucaucagcgugaagcugggcaagauccccaccguggagaacuccaucuuccacauggccgccuggaguggguccgccugccacgacggcaaggaguggacguacaucggggucgacggcccggauucgaacgcgcugcucaagaucaaguacggcgaggccuacaccgacaccuaucacuccuacgccaagaacauccugcgcacccaggagagcgccugcaauugcaucgggggcgacugcuaccugaugaucacggacgggcccgccaguggcaucuccgagugccgguuccucaagauccgcgagggccggaucaucaaggagaucuuccccaccgggcgcgugaagcacaccgaggagugcacguguggcuucgcgagcaacaagaccaucgagugcgccugccgggauaacuccuacaccgccaagcgccccuucgugaagcugaacgucgagaccgacaccgccgagauccggcugauguguacggagaccuaccucgacaccccgcgccccaacgacgggagcaucaccggccccugugaguccgacggggacaagggcagcggcgggaucaagggcggguucgugcaccagcggauggccuccaagaucggccgcugguauagccggacgauguccaagaccaagcgcauggggaugggccuguacgugaaguacgacggcgaccccuggaccgauagcgaggcgcuggcccucuccggggucauggugagcauggaggagccgggcugguacuccuucggguucgagaucaaggauaagaagugcgacgugcccugcaucggcaucgagaugguccacgacgggggcaagaccacguggcauagcgccgccaccgccguguacugccugaugggcuccgggcagcugcucugggacaccgugaccggcgucgacauggcgcuguga

SEQ ID NO: 29988 - RNA, 1401 nt, Artificial Sequence
  derived and/or modified CDS sequence (AUadapt) from InfluenzaB__AGX24759__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaacgccaguaacgugcaggccgugaaccgcuccgccgccaagggcgucacgcuccugcugcccgagcccgaguggaccuacccgcggcucagcugccccggguccaccuuucagaaggcgcugcugaucagcccccaccgcuucggcgagaccaaggggaacuccgcgccccucaucauccgggagccguucaucgccugcggccccacggaguguaagcacuucgcccugacccacuacgccgcccagcccggcggguacuacaauggcacccgcgaggaccggaacaagcugcgccaccucaucagcgugaagcuggggaagauccccaccguggagaacuccaucuuucacauggccgccuggagcggcuccgccugccacgacgggaaggaguggacguacaucggcgucgauggcccggacucgaacgcgcugcucaagaucaaguacggggaggccuacaccgauaccuaccacuccuacgccaagaacauccugcggacccaggagagcgccugcaauugcaucggcggggacugcuaccugaugaucacggacggccccgccagcggcaucuccgagugucgcuuccucaagauccgggaggggcgcaucaucaaggagaucuuccccaccggccgggugaagcacaccgaggagugcacgugcggguuugcgagcaacaagaccaucgagugcgccugccgcgacaacuccuauaccgccaagcggcccuucgugaagcugaacgucgagaccgacaccgccgagauccgccugaugugcacggagaccuaccucgauaccccgcggcccaacgacggcagcaucaccgggcccugcgaguccgacggcgacaagggcagugggggcaucaagggcggguucgugcaccagcgcauggccuccaagaucgggcggugguacagccgcacgauguccaagaccaagcggaugggcaugggccuguacgugaaguacgauggggaccccuggaccgacagcgaggcgcuggcccucuccggcgucauggugagcauggaggagccggggugguacuccuuuggcuucgagaucaaggacaagaagugcgacauccccugcaucgggaucgagauggugcacgauggcggcaagaccacguggcacagcgccgccaccgccaucuacugccugaugggguccggccagcugcucugggacaccgucaccgggguggacauggcgcuguga

SEQ ID NO: 29989 - RNA, 1401 nt, Artificial Sequence; identical to SEQ ID NO: 29525
  derived and/or modified CDS sequence (AUadapt) from InfluenzaB__AGX24770__NA

SEQ ID NO: 29990 - RNA, 1401 nt, Artificial Sequence; identical to SEQ ID NO: 29987
  derived and/or modified CDS sequence (AUadapt) from InfluenzaB__AGX24781__NA

SEQ ID NO: 29991 - RNA, 1401 nt, Artificial Sequence; identical to SEQ ID NO: 28901
  derived and/or modified CDS sequence (AUadapt) from InfluenzaB__AGX24792__NA

SEQ ID NO: 29992 - RNA, 1401 nt, Artificial Sequence; identical to SEQ ID NO: 29949
  derived and/or modified CDS sequence (AUadapt) from InfluenzaB__AGX24803__NA

SEQ ID NO: 29993 - RNA, 1401 nt, Artificial Sequence; identical to SEQ ID NO: 29525
  derived and/or modified CDS sequence (AUadapt) from InfluenzaB__AGX24814__NA

SEQ ID NO: 29994 - RNA, 1401 nt, Artificial Sequence
  derived and/or modified CDS sequence (AUadapt) from InfluenzaB__AGX24825__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgaucaugccccuggacugugcgaacgccagcaacgugcaggccgugaaccgcuccgccgccaagggcgucacgcuccugcugcccgagcccgaguggaccuacccgcggcucaguugccccggguccaccuuccagaaggcgcugcugaucagcccccaccgcuucggcgagaccaaggggaauuccgcgccccucaucauccgggagccguucaucgccugcggccccacggagugcaagcacuucgcccugacccauuacgccgcccagcccggcgaguacuacaacgggacccgcgaggaccggaauaagcugcgccaccucaucagcgugaagcugggcaagauccccaccguggagaacuccaucuuccacauggccgccuggaguggguccgccugccacgacggcaaggaguggacguacaucggggucgacggcccggauucgaacgcgcugcucaagaucaaguacggcgaggccuacaccgacaccuaucacuccuacgccaagaacauccugcggacccaggagagcgccugcaauugcaucgggggcgacugcuaccugaugaucacggacgggcccgccaguggcaucuccgagugccgcuuccucaagauccgggagggccgcaucaucaaggagaucuuccccaccgggcgggugaagcacaccgaggagugcacguguggcuucgcgagcaacaagaccaucgagugcgccugccgcgauaacuccuacaccgccaagcggcccuucgugaagcugaacgucgagaccgacaccgccgagauccgccugauguguacggagaccuaccucgacaccccgcggcccaacgacgggagcaucaccggccccugugaguccgacggggacaagggcagcggcgggaucaagggcggguucgugcaccagcgcauggccuccaagaucggccggugguauagccgcacgauguccaagacccggcgcauggggaugggccuguacgugaaguacgacggcgaccccuggaccgauagcgaggcgcuggcccucuccggggucauggugagcauggaggagccgggcugguacuccuucggguucgagaucaaggauaagaagugcgacgugcccugcaucggcaucgagaugguccacgacgggggcaagaccacguggcauagcgccgccaccgccaucuacugccugaugggcuccgggcagcugcucugggacaccgugaccggcguggacauggcgcuguga

SEQ ID NO: 29995 - RNA, 1401 nt, Artificial Sequence; identical to SEQ ID NO: 29525
  derived and/or modified CDS sequence (AUadapt) from InfluenzaB__AGX24836__NA

SEQ ID NO: 29996 - RNA, 1401 nt, Artificial Sequence
  derived and/or modified CDS sequence (AUadapt) from InfluenzaB__AGX24847__NA
augcugcccaguaccauccagacccucacgcuguuccugaccuccggcggggugcuccugagccuguacgucuccgccagccucuccuaccugcuguauagcgacauccuccugaaguucucccgcaccgagaucaccgccccgaucaugccccuggacugcgcgaacgccaguaacgugcaggccgugaaccgguccgccacgaagggcgucacccuccugcugcccgagcccgaguggaccuacccgcgccucagcugccccggguccaccuuucagaaggcccugcugaucagcccccaccgguucggcgagacgaaggggaacuccgcgccccucaucauccgcgagccguucaucgccugcggccccaaggaguguaagcacuucgcccugacccacuacgccgcgcagcccggcggguacuacaauggcacccgggaggaccgcaacaagcugcggcaccucaucagcgugaagcuggggaagauccccaccguggagaacuccaucuuucacauggccgccuggagcggcuccgccugccacgacgggcgcgaguggacguacaucggcgucgauggcccggacucgaacgcccugcucaagaucaaguacggggaggcguacaccgauaccuaccacuccuacgccaagaacauccugcggacccaggagagcgccugcaauugcaucggcggggacugcuaccugaugaucacggacggccccgccagcggcaucuccgagugucgcuuccucaagauccgggaggggcgcaucaucaaggagaucuuccccaccggccgggugaagcacaccgaggagugcacgugcggguuugccagcaacaagaccaucgagugcgcgugccgcgacaacuccuauaccgccaagcggcccuucgugaagcugaacgucgagaccgacaccgccgagauccgccugaugugcacggagaccuaccucgauaccccgcggcccaacgacggcagcaucaccgggcccugcgaguccaacggcgacaagggcagugggggcaucaagggcggguucgugcaccagcgcauggccuccaagaucgggcggugguacagccgcacgauguccaagaccaagcggaugggcaugggccuguacgugaaguacgauggggaccccuggaccgacagcgaggcccuggcgcucuccggcgucauggugagcauggaggagccggggugguacuccuuuggcuucgagaucaaggacaagaagugcgacgugcccugcaucgggaucgagaugguccacgauggcggcaagaccacguggcacagcgccgccaccgccguguacugccugaugggguccggccagcugcucugggacaccgugaccggggucaacaugacgcuguga

SEQ ID NO: 29997 - RNA, 1401 nt, Artificial Sequence; identical to SEQ ID NO: 29009
  derived and/or modified CDS sequence (AUadapt) from InfluenzaB__AGX24858__NA

SEQ ID NO: 29998 - RNA, 1401 nt, Artificial Sequence
  derived and/or modified CDS sequence (AUadapt) from InfluenzaB__AGX24869__NA
augcugcccaguaccauccagacccucacgcuguuccugaccuccggcggggugcuccugagccuguacgucuccgccagccucuccuaccugcuguauagcgacauccuccugaaguucucccgcaccgagaugaccgccccgaucaugccccugggcugcgcgaacgccucgaaugugcaggccgugaaccgguccgccacgaagggggucacccuccugcugcccgagcccgaguggaccuacccgcgccucagcugccccggcuccaccuuccagaaggcccugcugaucaguccccaccgguucggggagacgaagggcaacuccgcgccccucaucauccgcgagccguucaucgccugcggccccaaggagugcaagcauuucgcccugacccacuacgccgcgcagcccgggggcuacuacaaugggacccgggaggaccgcaacaagcugcggcaccucaucagcgugaagcugggcaagauccccaccguggagaacuccaucuuccauauggccgccuggagcggguccgccugccacgacggccgcgaguggacguacaucggcgucgaugggccggacucgaacgcccugcucaagaucaaguacggcgaggcguacaccgacaccuaucacuccuacgccaagaacauccugcggacccaggagagcgccugcaacuguaucgggggcgacugcuaccugaugaucacggacggccccgccagcgggaucuccgagugucgcuuccucaagauccgggagggccgcaucaucaaggagaucuuccccaccgggcgggugaagcacaccgaggagugcacgugcggcuucgccaguaacaagaccaucgagugcgcgugccgcgacaacuccuauaccgccaagcggcccuucgugaagcugaacgucgagaccgacaccgccgagauccgccugaugugcacggagaccuaccucgacaccccgcggcccaaugacgggagcaucaccggccccugcgaguccaacggcgacaaggggaguggcgggaucaagggcggguucgugcaccagcgcauggccuccaagaucggccggugguacagccgcacgauguccaagaccaagcggaugggcauggggcuguacgugaaguacgauggcgaccccuggaccgacagcgaggcccuggcgcucuccggggucauggugagcauggaggagccgggcugguacuccuuuggguucgagaucaaggacaagaagugcgacgugcccugcaucggcaucgagaugguccacgauggcgggaagaccacguggcacagcgccgccaccgccaucuacugccugaugggcuccgggcagcugcucugggacaccgugaccggcgugaacaugacgcuguga

SEQ ID NO: 29999 - RNA, 1401 nt, Artificial Sequence
  derived and/or modified CDS sequence (AUadapt) from InfluenzaB__AGX24880__NA
augcugcccaguaccauccagaugcucacccuguuccugacguccggcggggugcuccugagccuguacgucuccgccagccucuccuaccugcuguacagugacauccuccugaaguucucccgcaccgagaucaccgccccgaucaugccccuggacugcgcgaacgccagcaaugugcaggccgugaaccgguccgccaccaagggcgucacgcuccugcugcccgagcccgaguggaccuacccgcgccucagcugccccggguccaccuuccagaaggcccugcugaucagcccccaccgguuuggcgagaccaaggggaacuccgcgccccucaucauccgcgagccguucaucgccugcggccccaaggagugcaagcacuucgcccugacgcauuacgccgcgcagcccggcggguacuacaacggcacccgggaggaccgcaacaagcugcggcaccucaucagugugaagcuggggaagauccccaccguggagaacuccaucuuccacauggccgccuggagcggcuccgccugccacgaugggcgcgaguggaccuacaucggcgucgacggcccggacagcaacgcccugcucaagaucaaguacggggaggcguacacggauaccuaccacuccuacgccaagaacauccugcggacccaggagagcgccugcaauugcaucggcggggacugcuaccugaugaucaccgacggccccgccucgggcaucuccgagugucgcuuccucaagauccgggaggggcgcaucaucaaggagaucuuccccacgggccgggugaagcacaccgaggagugcacgugcggguucgccagcaauaagaccaucgagugcgcgugccgcgacaacuccuacaccgccaagcggcccuucgugaagcugaaugucgagaccgacaccgccgagauccgccugaugugcaccgagacguaccucgacaccccgcggcccaacgacggcagcaucaccgggcccugugaguccaacggcgacaagggcagcgggggcaucaagggcggguucgugcaccagcgcauggccuccaagaucgggcggugguacagucgcaccauguccaagacgaagcggaugggcaugggccuguacgugaaguacgacggggaccccuggaccgacagcgaggcccuggcgcucuccggcgucauggugagcauggaggagccggggugguauuccuucggcuucgagaucaaggacaagaagugcgacgugcccugcaucgggaucgagaugguccaugacggcggcaagaccaccuggcacagcgccgccacggccaucuacugccugaugggguccggccagcugcucugggacaccgugaccggggugaacaugacccuguga

SEQ ID NO: 30000 - RNA, 1401 nt, Artificial Sequence
  derived and/or modified CDS sequence (AUadapt) from InfluenzaB__AGX24902__NA
augcugcccaguaccauccagacccucacgcuguuccugaccuccggcggggugcuccugagccuguacgucuccgcccuccugucguaccugcucuacuccgacauccugcugaaguuuagccgcaccgagaucaccgccccgaucaugccccucgacugcgcgaacgccuccaacgugcaggccgugaaccggagcgccacgaagggcgucacccugcugcuccccgagcccgaguggaccuauccgcgccuguccugccccgggucgaccuuccagaaggcccugcucaucagcccccaccgguucggcgagaacaaggggaauuccgcgccccugaucauccgcgagccguucaucgccugcggccccaaggagugcaagcacuucgcccugacgcacuacgccgcgcagcccggcggguauuacaacggcacccgggaggaccgcaacaagcuccggcaccugaucuccgugaagcuggggaagauccccaccguggagaacucgaucuuucacauggccgccugguccggcagcgccugccacgacgggcgcgaguggaccuacaucggcgucgacggcccggauuccaacgcccuccugaagaucaaguacggggaggcguacacggacaccuaccacagcuaugccaagaacauccugcggacccaggaguccgccugcaacugcaucggcggggacugcuaccucaugaucaccgauggccccgccucgggcaucagcgagugccgcuuccugaagauccgggaggggcgcaucaucaaggagaucuuccccacgggccgggugaagcacaccgaggagugcacguguggguucgccuccaacaagaccaucgagugcgcgugccgcgacaacaacuauaccgccaagcggcccuucgugaagcugaacgucgagaccgacaccgccgagauccgccucaugugcaccgagacguaccuggacaccccgcggcccaacgauggcucgaucaccgggcccugcgaguccaacggcgacaagggcagcgggggcaucaagggcggguucgugcaccagcgcauggccuccaagaucgggcggugguauagccgcaccauguccaagacgaagcggaugggcaugggccuguacgugaaguacgacggggaccccuggaccgacucggaggcccucgcgcuguccggcgucauggugaguauggaggagccggggugguacuccuucggcuucgagaucaaggacaagaagugcgacgugcccugcaucgggaucgagaugguccaugacggcggcaagaccaccuggcacagcgccgccacggccaucuacugccugaugggguccggccagcuccugugggacaccgugaccggggugaacaugacccuguga

SEQ ID NO: 30001 - RNA, 1401 nt, Artificial Sequence; identical to SEQ ID NO: 29014
  derived and/or modified CDS sequence (AUadapt) from InfluenzaB__AGX84846__NA

SEQ ID NO: 30002 - RNA, 1401 nt, Artificial Sequence; identical to SEQ ID NO: 29069
  derived and/or modified CDS sequence (AUadapt) from InfluenzaB__AGX84858__NA

SEQ ID NO: 30003 - RNA, 1401 nt, Artificial Sequence; identical to SEQ ID NO: 29014
  derived and/or modified CDS sequence (AUadapt) from InfluenzaB__AGX84869__NA

SEQ ID NO: 30004 - RNA, 1401 nt, Artificial Sequence
  derived and/or modified CDS sequence (AUadapt) from InfluenzaB__AGX84880__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugagccuggacugcgcgaacgccuccaacgugcaggccgugaaucgcucggccaccaagggcgucaucuuccuccugcccgagcccgaguggaccuacccgcggcuguccugccccgggagcaccuuccagaaggcccuccugaucagcccccaucgcuucggcgagacgaaggggaacuccgcgccccugaucauccgggagccguucaucgccugcggccccaacgagugcaagcacuuugcccucacccacuacgccgcgcagcccggcggguacuacaacggcacccgcggggaccggaacaagcugcgccaucugaucuccgugaagcucggcaagauccccaccguggagaacagcaucuuccacauggccgccugguccgggagcgccugccacgauggcaaggaguggacguacaucggcgucgacgggccggacaacgacgcccugcugaaggugaaguacggcgaggcguacaccgauaccuaccacuccuacgccaacaagauccuccggacccaggagucggccugcaacuguaucgggggcaacugcuaccugaugaucacggacggcagcgccuccggggugagcgagugucgcuuccugaagauccgggagggccgcaucaucaaggagaucuuccccaccgggcgggucaagcacaccgaggagugcacgugcggcuucgccuccaacaagaccaucgagugugcgugccgcgacaacagcuacaccgccaagcggcccuucgugaagcucaacguggagaccgauaccgccgagauccgccugaugugcacggacaccuaccuggacacgccccggccggacgacggguccaucaccggccccugcgagaguaacggcgacaagggguccggcgggaucaagggcggguucguccaccagcgcauggagucgaagaucggccggugguacucccgcaccaugagcaagaccgagcggaugggcauggggcucuaugugaaguacgacggcgaccccugggccgacuccgacgcccuggcguucagcggggugauggucuccaugaaggagcccggcugguauagcuucggguucgagaucaaggacaagaagugcgacgugccgugcaucggcaucgagauggugcaugacggcgggaaggagaccuggcacuccgccgccaccgccaucuacugccugaugggcagcgggcagcuccugugggacacggucaccggcguggacauggcccuguga

SEQ ID NO: 30005 - RNA, 1401 nt, Artificial Sequence; identical to SEQ ID NO: 29014
  derived and/or modified CDS sequence (AUadapt) from InfluenzaB__AGX84891__NA

SEQ ID NO: 30006 - RNA, 1401 nt, Artificial Sequence; identical to SEQ ID NO: 29069
  derived and/or modified CDS sequence (AUadapt) from InfluenzaB__AGX84902__NA

SEQ ID NO: 30007 - RNA, 1401 nt, Artificial Sequence
  derived and/or modified CDS sequence (AUadapt) from InfluenzaB__AGX84924__NA
augcugcccaguaccauccagacccucacgcuguuccugaccuccggcggggugcuccugagccuguacgucuccgcccuccugagcuaccugcucuacuccgauauccugcugaaguucagcccgaccgagaucaccgcccccacgaugucccucgacuacgcgaacgccucgaacgugcaggccgugaaucgcuccgccaccaagggcgucaccuuccugcugcccgagcccgaguggaccuacccgcggcucagcugccccggguccacguuccagaaggcccugcugaucagcccccaccgcuuuggcgagaccaaggggaacuccgcgccccucaucauccgggagccguucaucgccugcggccccaacgagugcaagcacuucgcccugacccauuacgccgcgcagcccggcggguacuacaacggcacccgcggggaccggaacaagcugcgccaccucaucagugugaagcugggcaagauccccacgguggagaacuccaucuuccacauggccgccuggagcggguccgccugccacgauggcaaggaguggaccuacaucggcgucgacgggccggacaacgacgcccugcucaaggugaaguacggcgaggcguacaccgauaccuaccacucguacgccaacaagauccugcggacgcaggaguccgccugcaacuguaucgggggcaacugcuaccugaugaucaccgacggcagcgccagcgggguguccgagugccgcuuucucaagauccgggagggccgcaucaucaaggagaucuuccccaccgggcgggucaagcacaccgaggagugcacgugcggcuucgccagcaacaagaccaucgagugugcgugccgcgacaacuccuacaccgccaagcggcccuucgugaagcugaacguggagaccgauacggccgagauccgccugaugugcaccgacaccuaccucgacacgccccggccggacgacgggagcaucaccggccccugugaguccaacggcgacaaggggucgggcgggaucaagggcggguucguccaccagcgcauggaguccaagaucggccggugguacagccgcaccauguccaagaccgagcggaugggcauggggcuguaugugaaguacgacggcgaccccugggccgacagcgacgcccuggcguucuccggggugauggucaguaugaaggagcccggcugguacuccuucggguucgagaucaaggacaagaagugcgacgugccgugcaucggcaucgagauggugcaugacggcgggaaggagaccuggcacagcgccgccacggccaucuacugccucaugggcuccgggcagcugcugugggacaccgucaccggcguggacauggcccucuga

SEQ ID NO: 30008 - RNA, 1401 nt, Artificial Sequence
  derived and/or modified CDS sequence (AUadapt) from InfluenzaB__AGY46393__NA
augcugcccaguaccauccagacccucacgcuguuccugaccuccggcggggugcuccugagccuguacgucuccgccagccucuccuaccugcuguauagcgacauccuccugaaguucccguccaccgagaucaccgcccccacgaugccccuggacugcgcgaaugccaccaacgugcaggccgugaaccgcagcgccaccaagggcgucacccuccugcugcccgagccggaguggacguacccccggcucuccugccccgggagcaccuuucagaaggcccugcugaucucgccccaccgcuucggcgagaucaaggggaacuccgcgccgcucaucauccgggagcccuucaucgccuguggccccaacgagugcaagcacuucgcccugacccacuacgccgcgcagcccggcggguauuacaacggcacccgcgaggaccggaacaagcugcgccaccucaucuccgugaagcuggggaagaucccgacgguggagaauagcaucuuccacauggccgccugguccggcagcgccugccaugacgggcgggaguggaccuacaucggcgucgacggccccgacuccaacgcccugcucaagaucaaguacggggaggcguauaccgacaccuaccacagcuacgccaagaauauccugcgcacgcaggaguccgccugcaacugcaucggcggggacugcuaccugaugaucaccgauggccccgccagcggcaucagcgagugccgguuccucaagauccgcgaggggcggaucaucaaggagaucuuccccaccggccgcgugaagcauaccgaggagugcacgugcggguucgccuccaacaagaccaucgagugcgcgugccgggauaacucguacaccgccaagcgcccguucgugaagcugaacgucgagaccgauacggccgagauccggcugaugugcaccgagaccuaccucgacacgccccgccccaacgacggcuccaucaccgggcccugugagagcaacggcgacaagggcuccgggggcaucaagggcggguucgugcaccagcggauggccagcaagaucgggcgcugguauucccggaccaugagcaagaccgagcgcaugggcaugggccuguacgugaaguacgacggggacccgugggccgauuccgacgcgcuggccuucagcggcgucaugguguccauggaggagcccgggugguacagcuucggcuuugagaucaaggacaagaagugcgacgugcccugcaucgggaucgagaugguccacgauggcggcaaggagaccuggcacuccgccgccacggccaucuacugccucauggggagcggccagcugcugugggacaccgugaccggggugaacauggcgcucuga

SEQ ID NO: 30009 - RNA, 1401 nt, Artificial Sequence
  derived and/or modified CDS sequence (AUadapt) from InfluenzaB__AGY46397__NA
augcugcccaguaccauccagacccucacgcuguuccugaccuccggcggggugcuccugagccuguacgucuccgccagccucuccuaccugcuguacucggauauccuccugaaguucucccgcaccgagaucaccgccccgaucaugccccuggacugcgcgaacgccagcaacgugcaggccgugaaccgguccgccacgaagggcgucacccuccugcugcccgagcccgaguggaccuauccgcgccucagcugccccggguccaccuuccagaaggcccugcugaucucgccccaccgguucggcgagacgaaggggaacuccgcgccccucaucauccgcgagccguuuaucgccugcggccccaacgagugcaagcacuucgcccugacccacuacgccgcgcagcccggcggguacuauaacggcacccgcggggaccggaacaagcugcggcaccucaucagcgugaagcugggcaagauccccaccguggagaacuccaucuuccauauggccgccuggagcggguccgccugccacgacggcaaggaguggacguacaucggcgucgacgggccggacaauaacgcccugcucaaggugaaguacggcgaggcguacaccgacaccuaccacucguaugccaacaagauccugcgcacccaggaguccgccugcaacugcaucgggggcaacugcuaccugaugaucacggacggcagugccagcgggguguccgagugccgguuccucaagauccgcgagggccggaucaucaaggagaucuuccccaccgggcgcgucaagcacaccgaggagugcacgugcggcuuugccucgaacaagaccaucgagugcgcgugccgggacaacuccuacaccgccaagcgccccuuugugaagcugaacguggagaccgacaccgccgagauccggcugaugugcacggacaccuaccucgacacgccccgcccgaacgaugggagcaucaccggccccugcgaguccgacggcgacaaggggagcggcgggaucaagggcggguucguccaccagcggauggaguccaagaucggccgcugguacagucggaccauguccaagaccgagcgcaugggcauggggcuguacgugaaguacgacggcgaccccugggccgacagcgacgcccuggcguuuuccggggugauggucagcaugaaggagcccggcugguacuccuucggguucgagaucaaggacaagaagugcgacgugccguguaucggcaucgagauggugcacgacggcgggaagaccaccuggcacagcgccgccacggccaucuacugccucaugggcuccgggcagcugcugugggacaccgucaccggcgugaacaugacccucuga

SEQ ID NO: 30010 - RNA, 1401 nt, Artificial Sequence
  derived and/or modified CDS sequence (AUadapt) from InfluenzaB__AGY46399__NA
augcugcccaguaccauccagacccucacgcuguuccugaccuccggcggggugcuccugagccuguacgucuccgccagccucuccuaucugcuguacagcgacauccuccugaaguucuccccgaccgagaucaucgcccccaccacgccccuggacugugcgaacgccagcaacgugcaggccgugaaccgcuccgccaccaagggcgucacccuccugcugcccgagccggaguggaccuacccccggcucaguugccccggguccacguuccagaaggcccugcugaucagcccccaccgcuuuggcgagaccaaggggaacuccgcgccgcucaucauccgggagcccuucaucgccugcggccccaaggagugcaagcacuuugcccugacccacuacgccgcgcagcccggcggguacuacaacggcacccgcgaggaucggaacaagcugcgccaccucaucagcgugaagcuggggaagaucccgacgguggagaacuccaucuuucacauggccgccuggagcggcuccgccugccacgacgggcgggaguggaccuauaucggcgucgacggccccgacucgaacgcccugcucaagaucaaguacggggaggcguauaccgacaccuaccacuccuacgccaagaauauccugcgcacgcaggagagcgccugcaacugcaucggcggggacuguuaccugaugaucaccgacggccccgccagcggcaucuccgagugccgguuccucaagauccgcgaggggcggaucaucaaggagaucuuucccaccggccgcgugaagcacaccgaggagugcacgugcggguucgccaguaacaagaccaucgagugcgcgugccgggacaacuccuauaccgccaagcgcccguucgugaagcugaacgucgagaccgacacggccgagauccggcugaugugcaccgagaccuaccucgauacgccccgccccaacgacggcagcaucaccgggcccugcgaguccaauggcgacaagggcagcgggggcaucaagggcggguucgugcaccagcggauggccuccaagaucgggcgcugguacagucggaccauguccaagaccaagcgcaugggcaugggccuguacgugaaguacgacggggacccgugggccgacagugaggcgcuggcccucuccggcgucauggugagcauggaggagcccgggugguacuccuucggcuucgagaucaaggauaagaagugcgacgugcccugcaucgggaucgagaugguccacgacggcggcaaggagaccuggcauagcgccgccacggccaucuacugccugaugggguccggccagcugcucugggacaccgugaccgggguggacauggcgcuguga

SEQ ID NO: 30011 - RNA, 1401 nt, Artificial Sequence
  derived and/or modified CDS sequence (AUadapt) from InfluenzaB__AGY46401__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccagcaacgugcaggccgugaaccgcuccgccaccaagggcgucacccuccugcugcccgagccggaguggaccuacccccggcucagcugccccggguccacguuucagaaggcccugcugaucucgccccaccgcuucggcgagaccaaggggaacuccgcgccgcucaucauccgggagcccuucaucgccuguggccccaaggagugcaagcacuucgcccugacccacuacgccgcgcagcccggcggguauuacaacggcacccgcgaggaccggaacaagcugcgccaccucaucagcgugaagcuggggaagaucccgacgguggagaauuccaucuuccacauggccgccuggagcggcuccgccugccacgaugggcgggaguggaccuacaucggcgucgacggccccgacagcaacgcccugcucaagaucaaguauggggaggcguacaccgacaccuaccacuccuacgccaagaacauccugcgcacgcaggagagugccugcaacugcaucggcggggacugcuaucugaugaucaccgacggccccgccagcggcaucuccgagugccgguuccucaagauccgcgaggggcggaucaucaaggagaucuuccccaccggccgcgugaagcacaccgaggaguguacgugcggguucgccucgaacaagaccaucgagugcgcgugucgggacaacuccuacaccgccaagcgcccguucgugaagcugaacgucgagaccgauacggccgagauccggcugaugugcaccgagaccuaccucgacacgccccgccccaacgacggcagcaucaccgggcccugugaguccaacggcgacaagggcagcgggggcaucaagggcggguucgugcaccagcggauggccuccaagaucgggcgcugguauagccggaccauguccaagaccaagcgcaugggcaugggccuguacgugaaguacgacggggacccgugggccgauagcgacgcgcuggccuucuccggcgucauggugagcaugaaggagcccgggugguacuccuucggcuuugagaucaaggacaagaagugcgacgugcccugcaucgggaucgagaugguccacgauggcggcaaggagaccuggcacagcgccgccacggccaucuacugccucaugggguccggccagcugcugugggacaccgugaccgggguggacauggcgcucuga

SEQ ID NO: 30012 - RNA, 1401 nt, Artificial Sequence; identical to SEQ ID NO: 28729
  derived and/or modified CDS sequence (AUadapt) from InfluenzaB__AGZ59825__NA

SEQ ID NO: 30013 - RNA, 1401 nt, Artificial Sequence; identical to SEQ ID NO: 28795
  derived and/or modified CDS sequence (AUadapt) from InfluenzaB__AGZ59836__NA

SEQ ID NO: 30014 - RNA, 1401 nt, Artificial Sequence; identical to SEQ ID NO: 29484
  derived and/or modified CDS sequence (AUadapt) from InfluenzaB__AGZ59847__NA

SEQ ID NO: 30015 - RNA, 1401 nt, Artificial Sequence
  derived and/or modified CDS sequence (AUadapt) from InfluenzaB__AGZ59858__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcacgccgugaaccgcuccgccaccaagggcgucacccuccugcugcccgagccggaguggaccuacccccggcucagcugccccggguccacguuccagaaggcccugcugaucagcccccaucgcuucggcgagaccaaggggaacuccgcgccgcucaucauccgggagcccuucaucgccugcggccccaacgagugcaagcauuucgcccugacccacuacgccgcgcagcccggcggguacuacaacggcaagcgcggggaccggaauaagcugcgccaccucaucucggugaagcugggcaagaucccgaccguggagaacuccaucuuccacauggccgccuggagcggguccgccugucacgacggcaaggaguggacguacaucggcgucgacgggcccgacaacaaugcccugcucaagaucaaguacggcgaggcguacaccgacaccuaccacagcuacgccaauaacauccugcggacccaggaguccgccugcaacugcaucgggggcaacugcuaucugaugaucacggacggcagcgccucggggguguccgagugccgcuuccucaagauccgggagggccgcaucaucaaggagaucuuccccaccgggcgggugaagcacaccgaggaguguacgugcggcuucgccagcaacaagaccaucgagugcgcgugccgcgauaacuccuacaccgccaagcggcccuucgucaagcugaacguggagaccgacaccgccgagauccgccugaugugcacggauaccuaccucgacaccccgcggcccgacgacgggagcaucaccggccccugcgaguccaacggcgauaaggggagcggcgggaucaagggcggguucgugcaccagcgcauggccuccaagaucggccggugguacucgcgcacgauguccaagaccgagcggaugggcauggggcuguacgucaaguaugacggcgaccccugggccgacagcgacgcgcuggccuucuccggggugauggugagcaugaaggagccgggcugguauuccuucggguucgagaucaaggacaagaagugcgacguccccugcaucggcaucgagauggugcaugacggcgggaaggagaccuggcacagcgccgccaccgccaucuacugccucaugggcuccgggcagcugcugugggacacggugaccggcgucgacauggcgcucuga

SEQ ID NO: 30016 - RNA, 1401 nt, Artificial Sequence
  derived and/or modified CDS sequence (AUadapt) from InfluenzaB__AGZ59869__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggccgugcugaucaguccccaccgcuucggcgagaccaaggggaacuccgcgccgcugaucauccgggagcccuucaucgccugcggccccaacgaguguaagcacuucgcccucacccacuacgccgcgcagcccggcggguacuacaauggcacccgcggggaccggaacaagcugcgccaccugaucagcgugaagcucggcaagaucccgacggucgagaacuccaucuuccauauggccgccuggagcggguccgccugccacgacggcaaggaguggaccuacaucggcguggacgggcccgauaacaacgcccugcugaagaucaaguacggcgaggcguacaccgacaccuaccauucguacgccaacaagauccuccggacgcaggaguccgccugcaacugcaucgggggcaauugcuaccugaugaucaccgacggcagcgccagcgggguguccgagugucgcuuccugaagauccgggagggccgcaucaucaaggagaucuuccccaccgggcgggucaagcacaccgaggagugcacgugcggcuucgccaguaacaagaccaucgagugcgcgugccgcgacaacuccuacaccgccaagcggcccuuugugaagcucaacguggagaccgacacggccgagauccgccugaugugcaccgacaccuaccuggacaccccgcggcccgaugacgggagcaucacgggccccugcgaguccaacggcgacaaggggucgggcgggaucaagggcggguuuguccaccagcgcauggccuccaagaucggccggugguacagccgcaccauguccaagaccgagcggaugggcauggggcucuacgugaaguacgacggcgaucccugggccgacagcgacgcgcuggccuucuccggggugauggucagcaugaaggagccgggcugguacuccuuuggguucgagaucaaggacaagaagugcgacgugcccugcaucggcaucgagauggugcacgauggcgggaaggagaccuggcacagcgccgccacggccaucuacugccugaugggcuccgggcagcuccugugggacaccgucaccggcguggacauggcgcuguga

SEQ ID NO: 30017 - RNA, 1401 nt, Artificial Sequence; identical to SEQ ID NO: 29513
  derived and/or modified CDS sequence (AUadapt) from InfluenzaB__AGZ59880__NA

SEQ ID NO: 30018 - RNA, 1401 nt, Artificial Sequence; identical to SEQ ID NO: 29957
  derived and/or modified CDS sequence (AUadapt) from InfluenzaB__AGZ59891__NA

SEQ ID NO: 30019 - RNA, 1401 nt, Artificial Sequence; identical to SEQ ID NO: 28640
  derived and/or modified CDS sequence (AUadapt) from InfluenzaB__AGZ59902__NA

SEQ ID NO: 30020 - RNA, 1401 nt, Artificial Sequence; identical to SEQ ID NO: 28640
  derived and/or modified CDS sequence (AUadapt) from InfluenzaB__AGZ59913__NA

SEQ ID NO: 30021 - RNA, 1401 nt, Artificial Sequence; identical to SEQ ID NO: 28640
  derived and/or modified CDS sequence (AUadapt) from InfluenzaB__AGZ59924__NA

SEQ ID NO: 30022 - RNA, 1401 nt, Artificial Sequence; identical to SEQ ID NO: 28640
  derived and/or modified CDS sequence (AUadapt) from InfluenzaB__AGZ59935__NA

SEQ ID NO: 30023 - RNA, 1401 nt, Artificial Sequence; identical to SEQ ID NO: 28640
  derived and/or modified CDS sequence (AUadapt) from InfluenzaB__AGZ59946__NA

SEQ ID NO: 30024 - RNA, 1401 nt, Artificial Sequence
  derived and/or modified CDS sequence (AUadapt) from InfluenzaB__AGZ59957__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaacgaguguaagcacuucgcccugacccacuacgccgcgcagcccggcggguacuacaauggcacccgcggggaccggaacaagcugcgccaccucaucagcgugaagcugggcaagaucccgacgguggagaacuccaucuuccauauggccgccuggagcggguccgccugccacgacggcaaggaguggaccuacaucggcgucgacgggcccgauaacaacgcccugcucaaggugaaguacggcgaggcguacaccgacaccuaccauucguacgccaacaagauccugcggacgcaggaguccgccugcaacugcaucgggggcaauugcuaccugaugaucaccgacggcagcgccagcgggguguccgagugucgcuuccucaagauccgggagggccgcaucaucaaggagaucuuccccaccgggcgggucaagcacaccgaggagugcacgugcggcuucgccaguaacaagaccaucgagugcgcgugccgcgacaacuccuacaccgccaagcggcccuuugugaagcugaacguggagaccgacacggccgagauccgccugaugugcaccgacaccuaccucgacaccccgcggcccaaugacgggagcaucacgggccccugcgaguccaacggcgacaaggggucgggcgggaucaagggcggguuuguccaccagcgcauggaguccaagaucggccggugguacagccgcaccauguccaagaccgagcggaugggcauggggcuguacgugaaguacgacggcgaucccugggccgacagcgacgcccuggcguucuccggggugauggucagcaugaaggagccgggcugguacuccuuuggguucgagaucaaggacaagaagugcgacgugcccugcaucggcaucgagauggugcacgauggcgggaagggcaccuggcacagcgccgccacggccaucuacugccucaugggguccggccagcugcugugggacaccgucaccggcguggacauggcccucuga

SEQ ID NO: 30025 - RNA, 1401 nt, Artificial Sequence; identical to SEQ ID NO: 28640
  derived and/or modified CDS sequence (AUadapt) from InfluenzaB__AGZ59969__NA

SEQ ID NO: 30026 - RNA, 1401 nt, Artificial Sequence; identical to SEQ ID NO: 28640
  derived and/or modified CDS sequence (AUadapt) from InfluenzaB__AGZ59980__NA

SEQ ID NO: 30027 - RNA, 1401 nt, Artificial Sequence; identical to SEQ ID NO: 28640
  derived and/or modified CDS sequence (AUadapt) from InfluenzaB__AGZ59991__NA

SEQ ID NO: 30028 - RNA, 1401 nt, Artificial Sequence; identical to SEQ ID NO: 28640
  derived and/or modified CDS sequence (AUadapt) from InfluenzaB__AGZ60003__NA

SEQ ID NO: 30029 - RNA, 1401 nt, Artificial Sequence
  derived and/or modified CDS sequence (AUadapt) from InfluenzaB__AGZ60014__NA
augcugcccaguaccauccagacccucacgcuguuccugaccuccggcggggugcuccugagccuguacgucuccgcccuccugagcuaccugcucuauuccgacauccugcugaaguucagcccgaccgagaucaccgcccccacgaugucccucgacugcgcgaacgccaguaacgugcaggccgugaaccgcuccgccaccaagggcgucaccuuccugcugcccgagcccgaguggaccuacccgcggcucagcugucccggguccacguuccagcgcgcccugcugaucagcccccaccgguucggcgaggcgaaggggaacuccgcgccccucaucauccgcgagccguucaucgccuguggccccaacgagugcaagcacuucgcccugacccacuaugccgcccagcccggcggguacuacaacggcacccgcggggaccggaacaagcugcggcaccucaucagugugaagcugggcaagauccccaccguggagaacuccaucuuccacauggccgccuggagcggguccgccugccacgauggcaaggaguggacguacaucggcgucgacgggccggacaacgacgcgcugcucaaggugaaguauggcgaggccuacaccgacaccuaccacagcuacgccaauaagauccugcgcacccaggaguccgccugcaacugcaucgggggcaacugcuaucugaugaucacggacggcagcgccagcgggguguccgagugccgguuccucaagauccgcgagggccagaucaucaaggagaucuuccccaccgggcgggucaagcauaccgaggagugcacgugcggcuucgcgagcaacaagaccaucgagugugccugccgcgacaacuccuacaccgccaagcggcccuucgugaagcugaacguggagaccgauaccgccgagauccgccugaugugcacggacaccuaccucgacacgccccggccggacgacgggaguaucaccggccccugcgaguccaacggcgacaaggggagcggcgggaucaagggcggguucguccaucagcgcauggaguccaagaucggccggugguacagccgcaccauguccaagaccgagcggaugggcauggggcuguacgugaaguacgacggcgaccccugggccgauagcgacgcgcuggccuucuccggggugauggucagcaugaaggagcccggcugguacuccuuuggguucgagaucaaggacaagaagugcgacgugccgugcaucggcaucgagauggugcacgauggcgggaaggagaccuggcacagcgccgccaccgccaucuacugccucaugggcuccgggcagcugcugugggacacggucaccggcguggacauggcgcucuga

SEQ ID NO: 30030 - RNA, 1401 nt, Artificial Sequence; identical to SEQ ID NO: 28662
  derived and/or modified CDS sequence (AUadapt) from InfluenzaB__AGZ60025__NA

SEQ ID NO: 30031 - RNA, 1401 nt, Artificial Sequence
  derived and/or modified CDS sequence (AUadapt) from InfluenzaB__AGZ60037__NA
augcugcccaguaccauccagacccucacgcuguuccugaccuccggcggggugcuccugagccuguacgucuccgcccuccugagcuaccugcucuacuccgauauccugcugaaguucagcccgaccgagaucaccgcccccacgaugucccucgacugcgcgaacgccagcaaugugcaggccgugaaccgcuccgccaccaagggcgucaccuuccugcugcccgagcccgaguggaccuacccgcggcucagcugccccggguccacguuccagaaggcccugcugaucaguccccaccgcuucggcgagaccaaggggaacuccgcgccccucaucauccgggagccguucaucgccugcggccccaacgagugcaagcauuucgcccugacccacuacgccgcgcagcccggcggguacuacaacggcacccgcggggaucggaacaagcugcgccaccucaucagcgugaagcugggcaagauccccacgguggagaacuccaucuuccacauggccgccuggaguggguccgccugccacgacggcaaggaguggaccuacaucggcgucgacgggccggacaacgaugcccugcucaaggugaaguacggcgaggcguacaccgacaccuaccacagcuaugccaacaagauccugcggacgcaggaguccgccugcaacugcaucgggggcaacugcuaucugaugaucaccgacggcagcgccagcgggguguccgagugccgcuuccucaagauccgggagggccgcaucaucaaggagaucuuccccaccgggcgggucaagcauaccgaggagugcacgugcggcuucgccucgaacaagaccaucgagugcgcgugccgcgauaacuccuacaccgccaagcggcccuucgugaagcugaacguggagaccgacacggccgagauccgccugaugugcaccgauaccuaccucgacacgccccggccggacgacgggagcaucaccggccccugcgaguccaauggcgacaaggggagcggcgggaucaagggcggguucguccaccagcgcauggaguccaagaucggccggugguacagccgcaccauguccaagaccgagcggaugggcauggggcuguacgugaaguaugacggcgaccccugggccgagagcgacgcccuggcguucuccggggugauggucagcaugaaggagcccggcugguauuccuucggguucgagaucaaggacaagaagugcgacgugccgugcaucggcaucgagauggugcaugacggcgggaaggagaccuggcacagcgccgccacggccaucuacugccucaugggcuccgggcagcugcugugggacaccgucaccggcguggacaucgcccucuga

SEQ ID NO: 30032 - RNA, 1401 nt, Artificial Sequence; identical to SEQ ID NO: 29244
  derived and/or modified CDS sequence (AUadapt) from InfluenzaB__AGZ60048__NA

SEQ ID NO: 30033 - RNA, 1401 nt, Artificial Sequence; identical to SEQ ID NO: 29244
  derived and/or modified CDS sequence (AUadapt) from InfluenzaB__AGZ60059__NA

SEQ ID NO: 30034 - RNA, 1401 nt, Artificial Sequence
  derived and/or modified CDS sequence (AUadapt) from InfluenzaB__AGZ60070__NA
augcugcccaguaccauccagacccucacgcuguuccugaccuccggcggggugcuccugucgcuguacgucuccgccagccucuccuaccugcuguacucggacauccuccugaaguucuccaccaccgagaucacggccccgaccaugccccuggacugugcgaacgccagcaacgugcaggccgugaaccacuccgccgccaagggcgucacccuccugcugcccgagcccgaguggaccuacccgcgccucucgugccccggguccacguuccagaaggcgcugcugaucagcccccaucgguucggcgagaccaaggggaacuccgcgccccucaucauccgcgagccguucaucgccugcggccccaaggagugcaagcacuucgcccugacccacuacgccgcccagcccggcggguacuauaacggcacccgggaggaccgcaacaagcugcggcaccucaucucggugaagcuggggaagauccccacgguggagaacuccaucuuccacauggccgccuggagcggcuccgccugccacgaugggaaggaguggaccuacaucggcgucgacggcccggacucgaacgcgcugcucaagaucaaguacggggaggccuacaccgacaccuaccacuccuaugcccacaacauccugcgcacgcaggagagcgccugcaacugcaucggcgggaacugcuaccugaugaucaccgacggcagugccuccggcaucagcgagugccgguuccucaagauccgcgaggggcggaucaucaaggagaucuuccccaccggccgcgugaagcacaccgaggagugcacgugcggguucgcgaacaacaagaccaucgagugugccugccgggacaacuccuacaccgccaagcgccccuucgugaagcugaacgucgagaccgacacggccgagauccggcugaugugcaccgagaccuaccucgacacgccccgcccggacgauggcucgaucaccgggcccugcgaguccaacggcaacaagggcagcgggggcaucaagggcggguucgugcaccagcggauggccuccaagaucgggcgcugguacucgcggaccauguccaagaccaagcgcaugggcaugggccuguacgugaaguaugacggggaccccuggaccgacagcgacgcgcuggucuucuccggcgugaugaucucgguggaggagcccgggugguacuccuucggcuucgagaucaaggauaagaagugcgacgucccgugcaucgggaucgagauggugcacgacggcggcaaggagacguggcacagcgccgccaccgccaucuacugccucaugggguccggccagcugcugugggacaccgugaccggggucaacaugacgcucuga

SEQ ID NO: 30035 - RNA, 1401 nt, Artificial Sequence; identical to SEQ ID NO: 28740
  derived and/or modified CDS sequence (AUadapt) from InfluenzaB__AGZ60081__NA

SEQ ID NO: 30036 - RNA, 1401 nt, Artificial Sequence; identical to SEQ ID NO: 29260
  derived and/or modified CDS sequence (AUadapt) from InfluenzaB__AGZ60092__NA

SEQ ID NO: 30037 - RNA, 1401 nt, Artificial Sequence; identical to SEQ ID NO: 29883
  derived and/or modified CDS sequence (AUadapt) from InfluenzaB__AGZ60103__NA

SEQ ID NO: 30038 - RNA, 1401 nt, Artificial Sequence; identical to SEQ ID NO: 28901
  derived and/or modified CDS sequence (AUadapt) from InfluenzaB__AGZ60135__NA

SEQ ID NO: 30039 - RNA, 1401 nt, Artificial Sequence; identical to SEQ ID NO: 29073
  derived and/or modified CDS sequence (AUadapt) from InfluenzaB__AGZ60154__NA

SEQ ID NO: 30040 - RNA, 1401 nt, Artificial Sequence
  derived and/or modified CDS sequence (AUadapt) from InfluenzaB__AGZ60164__NA
augcugcccaguaccacccagacgcucacccuguuccugaccuccggcggggugcuccugagccuguacgucuccgccagccucuccuaccugcuguauucggacauccuccugaaguucucccagaccgagaucacggccccgaucaugccccuggacugcgcgaaugccagcaacgugcaggccgugaaccgcuccgccgccaagggcgucacccuccugcugcccgagcccgaguggaccuacccgcggcucagcugucccggguccaccuuccagaaggcgcugcugaucaacccccaccgcuucggcgagacgaaggggaacagcgcgccccucaucauccgggagccguuuaucgccugcggccccaccgagugcaagcacuucgcccugacccacuaugccgcccagcccggcggguacuacaacggcacccgcgaggaccggaacaagcugcgccaucucaucuccgugaagcuggggaagauccccacgguggagaacucgaucuuccacauggccgccugguccggcagcgccugccaugacgggaaggaguggaccuacaucggcgucgacggcccggacuccaacgcgcugcucaagaucaaguauggggaggccuacaccgacaccuaccacagcuaugccaagaacauccugcggacgcaggaguccgccugcaacugcaucggcggggacugcuaucugaugaucaccgacggccccgccagcggcaucucggagugccgcuuccucaagauccgggaggggcgcaucaucaaggagaucuuucccaccggccgggugaagcacaccgaggagugcacgugcggguucgcguccaacaagaccaucgagugugccugccgcgacaacagcuacaccgccaagcggcccuucgugaagcugaaugucgagaccgacacggccgagauccgccugaugugcaccgagaccuaccucgacaccccgcggcccaacgauggcuccaucacggggcccugcgagagcgacggcgacaagggcuccgggggcaucaagggcggguucgugcaucagcgcauggccagcaagaucgggcggugguacucccgcaccaugucgaagaccaagcggaugggcaugggccuguacgugaaguacgacggggaucccuggaccgacuccgaggcgcuggcccucagcggcgucaugguguccauggaggagccggggugguacagcuucggcuuugagaucaaggacaagaagugcgacgugcccugcaucgggaucgagaugguccacgauggcggcaagacgaccuggcacuccgccgccaccgccaucuacugccugauggggagcggccagcugcucugggacaccgugacggggguggacauggcgcuguga

SEQ ID NO: 30041 - RNA, 1401 nt, Artificial Sequence; identical to SEQ ID NO: 29953
  derived and/or modified CDS sequence (AUadapt) from InfluenzaB__AGZ60176__NA

SEQ ID NO: 30042 - RNA, 1401 nt, Artificial Sequence; identical to SEQ ID NO: 28686
  derived and/or modified CDS sequence (AUadapt) from InfluenzaB__AGZ60187__NA

SEQ ID NO: 30043 - RNA, 1401 nt, Artificial Sequence; identical to SEQ ID NO: 28686
  derived and/or modified CDS sequence (AUadapt) from InfluenzaB__AGZ60198__NA

SEQ ID NO: 30044 - RNA, 1401 nt, Artificial Sequence; identical to SEQ ID NO: 28686
  derived and/or modified CDS sequence (AUadapt) from InfluenzaB__AGZ60210__NA

SEQ ID NO: 30045 - RNA, 1401 nt, Artificial Sequence
  derived and/or modified CDS sequence (AUadapt) from InfluenzaB__AGZ60221__NA
augcugcccaccaccauccagacgcucacccuguuucugaccucgggcggggugcuccugucccuguacgucagcgccucccucagcuaccugcuguacuccgauauccuccugaaguucucgcgcaccgagaucacggccccgaucaugccccuggacugcgcgaacgccuccaacgugcaggccgugaaucggagcgccaccaagggcgucacccuccugcugcccgagcccgaguggaccuacccgcgccucuccugccccgggagcacguuccagaaggcccugcugaucucgccccaucgguucggcgagaccaaggggaacuccgcgccccucaucauccgcgagccguucaucgccugcggccccaaggagugcaagcacuuugcccugacccacuacgccgcgcagcccggcggguacuacaacggcacccgggaggaccgcaauaagcugcggcaccucaucuccgugaagcuggggaagauccccacgguggagaacagcaucuuccacauggccgccugguccggcagcgccugucacgacgggcgcgaguggaccuacaucggcgucgacggcccggacuccaacgcccugcucaagaucaaguauggggaggcguacaccgacaccuaccacucguacgccaagaauauccugcggacgcaggaguccgccugcaacugcaucggcggggacugcuaccugaugaucaccgauggccccgccagcggcaucagcgagugccgcuuccucaagauccgggaggggcgcaucaucaaggagaucuuccccaccggccgggugaagcacaccgaggaguguacgugcggguucgccuccaacaagaccaucgagugcgcgugccgcgacaauucguacaccgccaagcggcccuucgugaagcugaacgucgagaccgacacggccgagauccgccugaugugcaccgagaccuaucucgacaccccgcggcccaacgacggcuccaucacggggcccugcgagagcaacggcgauaagggcuccgggggcaucaagggcggguucgugcaccagcgcauggccagcaagaucgggcggugguacucccgcaccaugucgaagaccaagcggaugggcaugggccuguacgugaaguaugacggggaccccuggaccgacuccgaggcccuggcgcucagcggcgucaugguguccauggaggagccggggugguacagcuuuggcuucgagaucaaggacaagaagugcgacgugcccugcaucgggaucgagaugguccacgauggcggcaagacgaccuggcacuccgccgccaccgccaucuacugccugauggggagcggccagcugcucugggacaccgugacgggggugaacaugacccuguga

SEQ ID NO: 30046 - RNA, 1401 nt, Artificial Sequence
  derived and/or modified CDS sequence (AUadapt) from InfluenzaB__AGZ60272__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaacgccaguaacgugcaggccgugaaccgcuccgccgccaagggcgucacgcuccugcugcccaagcccgaguggaccuacccgcggcucagcugccccggguccaccuuucagaaggcgcugcugaucagcccccaccgcuucggcgagaccaaggggaacuccgcgccccucaucauccgggagccguucaucgccugcggccccacggaguguaagcacuucgcccugacccacuacgccgcccagcccggcggguacuacaauggcacccgcgaggaccggaacaagcugcgccaccucaucagcgugaagcuggggaagauccccaccguggagaacuccaucuuucacauggccgccuggagcggcuccgccugccacgacgggaaggaguggacguacaucggcgucgauggcccggacucgaacgcgcugcucaagaucaaguacggggaggccuacaccgauaccuaccacuccuacgccaagaacauccugcggacccaggagagcgccugcaauugcaucggcggggacugcuaccugaugaucacggacggccccgccagcggcaucuccgagugucgcuuccucaagauccgggaggggcgcaucaucaaggagaucuuccccaccggccgggugaagcacaccgaggagugcacgugcggguuugcgagcaacaagaccaucgagugcgccugccgcgacaacuccuauaccgccaagcggcccuucgugaagcugaacgucgagaccgacaccgccgagauccgccugaugugcacggagaccuaccucgauaccccgcggcccaacgacggcagcaucaccgggcccugcgaguccgacggcgacaagggcagugggggcaucaagggcggguucgugcaccagcgcauggccuccaagaucgggcggugguacagccgcacgauguccaagaccaagcggaugggcaugggccuguacgugaaguacgauggggaccccuggaccgacagcgaggcgcuggcccucuccggcgucauggugagcauggaggagccggggugguacuccuuuggcuucgagaucaaggacaagaagugcgacgugcccugcaucgggaucgagaugguccacgauggcggcaagaccacguggcacagcgccgccaccgccaucuacugccugaugggguccggccagcugcucugggacaccgugaccgggguggacauggcgcuguga

SEQ ID NO: 30047 - RNA, 1398 nt, Artificial Sequence
  derived and/or modified CDS sequence (AUadapt) from InfluenzaB__AHL91182__NA
augcugcccaguaccauccagacccucacgcuguuccugaccuccggcggggugcuccugagccuguacgucuccgcccuccugagcuaccugcucuacuccgauauccugcugaaguucucgccgaagaucaucgcccccaccaugucccucgacugcgcgaacgccagcaacgugcaggccgugaaucacuccgccaccaaggagaugaaguuccugccgcccgagcccgaguggacguacccccgccugagcugccagggcuccaccuuccagaaggcccuccugaucucgccccaucgguucggggaggcgaagggcaacuccgcgccccugaucauccgcgagccguucaucgccugcgggcccaaggagugcaagcacuucgcccucacccauuacgccgcccagcccggcggcuacuacaacgggacccgggaggaccgcaacaagcugcggcaucugaucagcgucaaccucggcaagauccccacgguggagaacuccaucuuccacauggccgccuggagcggguccgccugccaugacggccgcgaguggaccuacaucgggguggacggcccggacucgaacgcgcugaucaagaucaaguacggcgaggccuauaccgacaccuaccacuccuacgccaacaacauccugcggacgcaggagagcgccuguaacugcaucgggggcgacugcuaccucaugaucaccgacgggagugccuccggcaucucgaagugccgcuuccugaagauccgggagggccgcaucaucaaggagaucuuccccaccgggcgggucgagcacaccgaggagugcacgugcggcuuugcguccaacaagaccaucgagugcgccugccgcgacaacagcuacaccgccaagcggcccuuugugaagcugaacguggagaccgacacggccgagauccgccucaugugcaccgagaccuaccuggacacgccccggccggacgacggguccaucaccggccccugugagagcaacggggacaagggccgcggcggggucaagggcggguucgugcaccagcggauggccuccaagaucggccgcugguacagucggaccauguccaagaccaagcgcauggggauggagcuguacgugaaguacgacggcgaccccuggaccgacagcgacgcgcucgcccccuccggcgucauggugaguauggaggagccggggugguacuccuucggcuucgagaucaaggacaagaagugcgacgugcccugcaucgggaucgagaugguccaugacggcgggaagcggacguggcacagcgccgccaccgccaucuacugccugaugggcuccggccagcugcucugggacaccgugaccgggguggacauggcgcuguga

SEQ ID NO: 30048 - RNA, 1398 nt, Artificial Sequence
  derived and/or modified CDS sequence (AUadapt) from InfluenzaB__AHL91193__NA
augcugcccaguaccauccagacccucacgcuguuccugaccuccggcggggugcuccugagccuguacgucuccgcccuccugucguaccugcucuacuccgacauccugcugaaguuuagcccgaagaucaucgcccccaccaugucccucgacugcgcgaacgccagcaacgugcaggccgugaaccauuccgccaccaaggagaugaaguuccugcccucggagcccgaguggacguacccgcgccuguccugccagggcagcaccuuccagaaggcccuccugaucagcccccaccgguuuggggaggcgaagggcaacuccgcgccccugaucauccgcgagcccuucaucgccugcgggccgaaggagugcaagcacuucgcccucacccacuaugccgcccagcccggcggcuacuacaacgggacccgggaggaccgcaacaagcugcggcaccugaucuccgucaaccucggcaagauccccacgguggagaauucgaucuuccacauggccgccugguccgggagcgccugccacgacggccgcgaguggaccuacaucgggguggauggccccgacuccaacgcgcugaucaagaucaaguacggcgaggccuacaccgacaccuaccacaguuacgccaacaacauccugcggacgcaggagucggccugcaacugcaucgggggcgauugcuaccucaugaucaccgacggguccgccagcggcaucuccaagugccgcuuccugaagauccgggagggccgcaucaucaaggagaucuucccgaccgggcgggucgagcacaccgaggaguguacgugcggcuucgcgagcaacaagaccaucgagugcgccugccgcgacaauuccuacaccgccaagcggcccuucgugaagcugaacguggagaccgacacggccgagauccgccucaugugcaccgagaccuaccuggacacgccccggcccgaugacgggucgaucaccggcccgugcgaguccaacggggacaagggccgcggcggggucaagggcggguucgugcaccagcggauggccagcaagaucggccgcugguauucccggaccaugagcaagaccaagcgcauggggauggagcuguacgugaaguacgacggcgaccccuggaccgacuccgacgcgcucgcccccaguggcgucaugguguccauggaggagcccgggugguacagcuucggcuucgagaucaaggacaagaagugcgacgugccguguaucgggaucgagaugguccacgacggcgggaagcggacguggcacuccgccgccaccgccaucuacugccugaugggcagcggccagcugcucugggacaccgugaccgggguggacauggcgcuguga

SEQ ID NO: 30049 - RNA, 1398 nt, Artificial Sequence
  derived and/or modified CDS sequence (AUadapt) from InfluenzaB__AHL91204__NA
augcugcccaguaccauccagacccucacgcuguuccugaccuccggcggggugcuccugagccuguacgucuccgcccuccugucguaccugcucuacuccgacgugcugcugaaguucaguccgaagaucaucgcccccaccaugucccucgacugcgcgaacgccucgaacgugcaggccgucaaccacuccgccaccgaggagaugacguuccugcugcccgagcccgaguggaccuacccgcgccucaguugccagggcuccaccuuccagaaggcccugcugaucagcccccaccgguucggggaggcgaagggcaacuccgcgccccucaucauccgcgagcccuucaucgccugcgggccgaaggaguguaagcacuucgcccugacccacuacgccgcccagcccggcggcuacuacaacgggacgcgggaggaccgcaacaagcugcggcaucucaucucggugaaccugggcaagauccccaccguggagaacuccaucuuccacauggccgccuggagcggguccgccugccacgacggccgcgaguggaccuauaucggggucgacggccccgacucgaacgcgcugaucaagaucaaguacggcgaggccuacaccgacacguaccauuccuacgccaacaacauccuccggacccaggagagcgccugcaacugcaucgggggcgacugcuaucugaugaucaccgacgggucggccuccggcaucagcaagugccgcuuccugaagauccgggagggccgcaucaucaaggagaucuucccgaccgggcggguggagcacacggaggagugcacguguggcuucgcguccaacaagaccaucgagugcgccugccgcgacaacaucuacaccgccaagcggcccuucgugaagcucaacgucgagaccgauaccgccgagauccgccugaugugcaccgagaccuaccuggacacgccccggcccgacgacgggagcaucaccggcccgugcgaguccaacggggacaagggccauggcgggaucaagggcggguucgugcaccagcgcauggccucgaagaucggccggugguacucccgcaccaugagcaagaccaagcggauggggauggagcucuacgugaaguacgacggcgaucccuggacggacuccgacgcgcuggcccccucgggcgucaugguguccauggaggagcccgggugguacagcuucggcuucgagaucaaggacaagaagugcgaugugccgugcaucgggaucgagaugguccacgacggcgggaagaagaccuggcacuccgccgccaccgccaucuacugccugaugggcagcggccagcuccugugggacaccgugacggggguggacauggcgcuguga

SEQ ID NO: 30050 - RNA, 1398 nt, Artificial Sequence
  derived and/or modified CDS sequence (AUadapt) from InfluenzaB__AHL91215__NA
augcugcccaguaccauccagacccucacgcuguuccugaccuccggcggggugcuccugagccuguacgucuccacccuccugucguaccugcucuacuccgacauccugcugaaguucaguccgaagaucaucgcccccaccacgucccucgacugcgccaacgcgucgaacgugcaggccgugaaccacuccgccaccaaggagaugaaguuccugcccaccgagcccgaguggaccuacccgcgccugaguugccagggcuccacguuccagaaggcccuccugaucucgccccaccgguucggggaggccaagggcaacuccgcgccccugaucauccgcgagcccuucaucgccugcgggccgaaggaguguaagcacuucgcccucacccacuacgccgcgcagcccggcggcuacuacaacgggacccgggaggaccgcaacaagcugcggcaucugaucagcgucaaccucggcaagauccccaccguggagaacuccaucuuccacauggccgccuggucgggguccgccugccacgacggccgcgaguggacguauaucgggguggacggccccgacagcaacgcccugaucaagaucaaguacggcgaggcguacaccgacaccuaccauuccuacgccaacaacauccugcggacccaggagucggccugcaacugcaucgggggcgacugcuaucucaugaucacggacgggagcgccuccggcaucucgaagugccgcuuccugaagauccgggagggccgcaucaucaaggagaucuucccgaccgggcgggucgagcacaccgaggagugcacguguggcuucgccuccaacaagaccaucgagugcgcgugccgcgacaacagcuacaccgccaagcggcccuucgugaagcugaauguggagaccgacaccgccgagauccgccucaugugcacggagaccuaccuggacacgccccggcccgacgacggguccaucaccggcccgugcgagucgaacggggauaagggcuccggcggggucaagggcggguucgugcaccagcgcaugaccagcaagaucggccggugguacucccgcaccaugucgaagaccaagcggauggggauggagcuguacgugaaguacgacggcgaucccuggaccgacuccgacgcccucgcccccagcggcgucaugguguccauggaggagcccgggugguacucguucggcuucgagaucaaggacaagaagugcgaugugccgugcaucgggaucgagaugguccacgacggcgggaagcgcacguggcacuccgcggccaccgccaucuacugccugaugggcagcggccagcugcucugggacaccgugaccgggguggacauggcccuguga

SEQ ID NO: 30051 - RNA, 1401 nt, Artificial Sequence; identical to SEQ ID NO: 28822
  derived and/or modified CDS sequence (AUadapt) from InfluenzaB__AHL91226__NA

SEQ ID NO: 30052 - RNA, 1401 nt, Artificial Sequence; identical to SEQ ID NO: 28823
  derived and/or modified CDS sequence (AUadapt) from InfluenzaB__AHL91237__NA

SEQ ID NO: 30053 - RNA, 1401 nt, Artificial Sequence; identical to SEQ ID NO: 28823
  derived and/or modified CDS sequence (AUadapt) from InfluenzaB__AHL91248__NA

SEQ ID NO: 30054 - RNA, 1401 nt, Artificial Sequence; identical to SEQ ID NO: 28822
  derived and/or modified CDS sequence (AUadapt) from InfluenzaB__AHL91259__NA

SEQ ID NO: 30055 - RNA, 1401 nt, Artificial Sequence; identical to SEQ ID NO: 28822
  derived and/or modified CDS sequence (AUadapt) from InfluenzaB__AHL91270__NA

SEQ ID NO: 30056 - RNA, 1398 nt, Artificial Sequence; identical to SEQ ID NO: 28794
  derived and/or modified CDS sequence (AUadapt) from InfluenzaB__AHL91281__NA

SEQ ID NO: 30057 - RNA, 1401 nt, Artificial Sequence
  derived and/or modified CDS sequence (AUadapt) from InfluenzaB__AHL91303__NA
augcugcccaguaccauccagacccucacgcuguuccugaccuccggcggggugcuccugagccuguacgucuccgccagccucuccuaucugcuguacagcgacauccuccugaaguucuccccgaccgagaucaccgcccccacgaugccccuggacugugcgaacgccagcaacgugcaggccgugaaccgcuccgccaccaagggcgucacccuccugcugcccgagccggaguggaccuacccccggcucaguugccccggguccacguuccagaaggcccugcugaucagcccccaccgcuucggcgagaccaaggggaauuccgcgccgcucaucauccgggagcccuucaucgccugcggccccaaggagugcaagcacuucgcccugacccauuacgccgcgcagcccggcggguacuacaacggcacccgcgaggaucggaacaagcugcgccaccucaucagcgugaagcuggggaagaucccgacgguggagaacuccaucuuccauauggccgccuggagcggcuccgccugccacgacgggcgggaguggaccuacaucggcgucgauggccccgacucgaacgcccugcucaagaucaaguacggggaggcguacaccgauaccuaccacuccuacgccaacaacauccugcgcacgcaggagagugccugcaacugcaucggcggggacuguuaccugaugaucaccgacggcagcgccuccggcaucaacgagugccgguuucucaagauccgcgaggggcggaucaucaaggagaucuuccccaccggccgcguggagcacaccgaggagugcacgugcggguucgccaguaacaagaccaucgagugcgcgugccgggacaacuccuauaccgccaagcgccccuucgugaagcugaacgucgagaccgacacggccgagauccggcugaugugcaccgagaccuaccucgauaccccgcgccccgacgacggcagcaucacggggcccugcgaguccaauggcgacaagggcagcgggggcaucaagggcggguucgugcaccagcggauggccuccaagaucgggcgcugguacagucggaccauguccaagacccgccggaugggcaugggccuguacgugaaguacgacggggaccccuggaccgacagugacgcccuggcgcucuccggcgucauggugagcauggaggagccggggugguacuccuucggcuucgagaucaaggauaagaagugcgacgugcccugcaucgggaucgagaugguccacgacggcggcaagaagacguggcauagcgccgccaccgccaucuacugccugaugggguccggccagcugcucugggacaccgugaccgggguggacauggcccuguga

SEQ ID NO: 30058 - RNA, 1401 nt, Artificial Sequence; identical to SEQ ID NO: 28823
  derived and/or modified CDS sequence (AUadapt) from InfluenzaB__AHL91314__NA

SEQ ID NO: 30059 - RNA, 1401 nt, Artificial Sequence; identical to SEQ ID NO: 28823
  derived and/or modified CDS sequence (AUadapt) from InfluenzaB__AHL91325__NA

SEQ ID NO: 30060 - RNA, 1401 nt, Artificial Sequence
  derived and/or modified CDS sequence (AUadapt) from InfluenzaB__AHL91347__NA
augcugcccaguaccauccagacccucacgcuguuccugaccuccggcggggugcuccugagccuguacgucuccgccagccucuccuaucugcuguacagcgacgugcuccugaaguucuccccgaccgagaucaccgcccccacgaugccccuggauugcgcgaacgccagcaacgugcaggccgucaaucgcuccgccaccaagggcgugacccuccugcugcccgagccggaguggaccuacccccggcucagcugccccggguccacguuccagaaggcccugcugaucagcccccaucgcuucggcgagaccaaggggaacuccgcgccgcucaucauccgggagcccuucaucgccugcggccccaaggaguguaagcacuucgcccugacccacuacgccgcgcagcccggcggguauuacaacggcacccgcgaggaccggaacaagcugcgccaucucaucagcgugaagcuggggaagaucccgacggucgagaacuccaucuuccacauggccgccuggagcggcuccgccugucacgacgggcgggaguggaccuacaucggcguggacggccccgauagcaacgcccugcucaagaucaaguacggggaggcguacaccgauaccuaccacuccuacgccaacaauauccugcgcacgcaggagagcgccugcaacugcaucggcggggacuguuaccugaugaucaccgacggcagcgccuccggcaucagcgagugucgguuccucaagauccgcgaggggcggaucgugaaggagaucuuccccaccggccgcgucgagcacaccgaggagugcacguguggguucgccuccaacaagaccaucgagugcgcgugccgggauaacagcuacaccgccaagcgccccuucgugaagcugaacguggagaccgauacggccgagauccggcugaugugcaccgagaccuaccucgacaccccgcgccccgaggacggcuccaucacggggcccugugagagcaacggcgacaagggcuccgggggcaucaagggcggguucguccaucagcggauggccagcaagaucgggcgcugguacucccggaccaugagcaagaccaagcgcaugggcaugggccuguacgugaaguaugacggggaccccuggaccgacuccgacgcccuggcgcucagcggcgugauggucuccauggaggagccggggugguauagcuucggcuucgagaucaaggacaagaagugugacgugcccugcaucgggaucgagauggugcacgacggcggcaaggagacguggcauuccgccgccaccgccaucuacugccugauggggagcggccagcugcucugggacaccgucaccgggguggacauggcccuguga

SEQ ID NO: 30061 - RNA, 1401 nt, Artificial Sequence; identical to SEQ ID NO: 30060
  derived and/or modified CDS sequence (AUadapt) from InfluenzaB__AHL91358__NA

SEQ ID NO: 30062 - RNA, 1401 nt, Artificial Sequence; identical to SEQ ID NO: 28798
  derived and/or modified CDS sequence (AUadapt) from InfluenzaB__AHL91369__NA

SEQ ID NO: 30063 - RNA, 1401 nt, Artificial Sequence; identical to SEQ ID NO: 28798
  derived and/or modified CDS sequence (AUadapt) from InfluenzaB__AHL91380__NA

SEQ ID NO: 30064 - RNA, 1401 nt, Artificial Sequence
  derived and/or modified CDS sequence (AUadapt) from InfluenzaB__AHL91391__NA
augcugcccaguaccauccagacccucacgcuguuccugaccuccggcggggugcuccugagccuguacgucuccgccagccucuccuaccugcuguacagugacauccuccugaaguucuccccgaaggagaucaccgcccccaccaugccccugaacugcgcgaacgccagcaaugugcaggccgugaaccgcuccgccacgaagggcgucacccucccccugccggagcccgaguggaccuacccccggcugagcugccccggguccaccuuccagaaggcccuccugaucucgccgcaucgcuucggcgagacgaaggggaacuccgcgccccugaucauccgggagcccuucaucgccugcggccccaaggagugcaagcacuuugcccucacccacuacgccgcgcagccgggcggguacuacaacggcacccgcgaggaccggaauaagcugcgccaccugaucagcgugaagcucgggaagauccccaccguggagaacuccaucuuccacauggccgccuggagcggcuccgccugccaugacgggcgggaguggacguacaucggcgucgacggccccgacaacaacgcccugcugaagaucaaguauggggaggcguacaccgacaccuaccacucguacgccaauaacauccuccgcacccaggaguccgccugcaacugcaucggcggggacugcuaucugaugaucacggacggcagcgccagcggcaucuccgagugccgguuccugaagauccgcgaggggcggaucaucaaggagaucuuccccaccggccgcguggagcauaccgaggagugcacgugcggguucgccucgaacaagaccaucgagugcgcgugucgggacaacuccuacaccgccaagcgcccguucgugaagcucaacgucgagaccgacaccgccgagauccggcugaugugcacggagaccuaucuggacacgccccgccccgacgacggcagcaucaccgggcccugcgaguccaacggcgauaagggcagcgggggcaucaagggcggguucgugcaccagcggauggccuccaagaucgggcgcugguacucgcggaccauguccaagaccaagcgcaugggcaugggccucuacgugaaguaugacggggacccguggaucgacagcgacgcccugacccuguccggcgucauggugagcauggaggagcccgggugguauuccuucggcuucgagaucaaggacaagaagugcgacgugcccugcaucgggaucgagaugguccaugacggcggcaagaccacguggcacagcgcggccaccgccaucuacugccucaugggguccggccagcugcugugggacaccgugaccgggguggacauggcccucuga

SEQ ID NO: 30065 - RNA, 1401 nt, Artificial Sequence
  derived and/or modified CDS sequence (AUadapt) from InfluenzaB__AHL91413__NA
augcugcccaguaccauccagacccucacgcuguuccugaccuccggcggggugcuccugagccuguacgucuccgccucgcucuccuaccugcuguacagcgauauccuccugaaguucaccccgaccgagaucacggcccccaccaugccccuggacugcgcgaacgccuccaacgugcaggccgugaaccucagcgccaccaagggcgucacccugcugcuccccgagccggaguggacguauccccgccuguccugccccgggucgaccuuccagaaggcccugcucaucagcccccaccgguucggcgagaccaaggggaacuccgcgccgcugaucauccgcgagcccuuuaucgccugcggccccaaggagugcaagcacuucgcccugacccacuacgccgcgcagcccggcggguacuauaacggcacgcgggaggaccgcaacaagcuccggcaccugaucuccgugaagcuggggaagaucccgaccguggagaacagcaucuuccauauggccgccugguccggcucggccugccacgacgggaaggaguggaccuacaucggcgucgacggccccgacuccaaugcccuccugaagaucaaguacggggaggcguacaccgacacguaccacagcuacgccaauaacauccugcgcacccaggaguccgccugcaacugcaucggcgggaacugcuaccucaugaucaccgauggcucggccagcggcaucuccgagugccgguuccugaagauccgcgaggggcggaucaucaaggagaucuuccccaccggccgcgugaagcacacggaggagugcacguguggguucgccagcaacaagaccaucgagugcgcgugccgggacaacuccuauaccgccaagcgccccuucgugaagcugaacgucgagaccgacaccgccgagauccggcucaugugcaccgagaccuaccuggacacgccgcgccccgacgauggcucgaucaccgggcccugcgaguccaacggcaacaagggcagcgggggcaucaagggcggguucgugcaccagcggauggccuccaagaucgggcgcugguauagccggaccauguccaagaccaagcgcaugggcaugggccuguacgugaaguacgacggggaccccuggacggacucggaugcccucgcgcuguccggcgucauggugagcauggaggagccggggugguacuccuucggcuucgagaucaaggacaagaagugcgacgugcccuguaucgggaucgagaugguccacgacggcggcaaggagaccuggcacagcgccgccaccgccaucuacugccugaugggguccggccagcuccugugggacaccgugacggggguggacauggcccuguga

SEQ ID NO: 30066 - RNA, 1401 nt, Artificial Sequence
  derived and/or modified CDS sequence (AUadapt) from InfluenzaB__AHL91446__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccgcuccgccaccaagggcaugacccuccugcugcccgagccggaguggaccuacccccggcucagcugccccggguccacguuccagaaggcccugcugaucucgccccaucgcuucggcgagaccaaggggaacuccgcgccgcucaucauccgggagcccuucaucgccugcggccccaaggagugcaagcacuuugcccugacccacuacgccgcgcagcccggcggguacuacaacggcacccgcgaggaccggaauaagcugcgccaccucaucagcgucaagcuggggaagaucccgacgguggagaacuccaucuuccacauggccgccuggagcggcuccgccugucacgacgggaaggaguggaccuacaucggcguggacggccccgacagcaaugcccugcucaagaucaaguacggggaggcguacaccgacaccuaccacuccuacgccaauaacauccugcggacgcaggagucggccugcaacugcaucggcgggaacugcuaucugaugaucaccgacggcagcgccuccggcaucagcgagugccgcuuccucaagauccgggaggggcgcaucaucaaggagaucuuccccaccggccgggucgagcauaccgaggagugcacgugcggguucgccuccaacaagaccaucgagugcgcgugccgcgauaacucguacaccgccaagcggcccuucgugaagcugaacguggagaccgacacggccgagauccgccugauguguaccgagaccuaccucgacaccccgcggcccgacgacggcuccaucacggggcccugcgagagcaauggcggcaagggguccggcgggaucaagggcggguucguccaccagcgcauggagagcaagaucggccggugguacucccgcaccaugucgaagaccaagcggaugggcauggggcuguacgugaaguaugacggcgaccccuggaccgacuccgacgcccuggcccucagcggggugauggucuccauggaggagccgggcugguacaguuucggguucgagaucaaggacaaggagugcgacgugcccugcaucggcaucgagauggugcaugacggcgggaaggagacguggcacuccgcggccaccgccaucuacugccugaugggcagcgggcagcugcucugggacaccgucaccggcgugaacauggcccuguga

SEQ ID NO: 30067 - RNA, 1401 nt, Artificial Sequence
  derived and/or modified CDS sequence (AUadapt) from InfluenzaB__AHL91457__NA
augcugcccaguaccauccagacccucacgcuguuccugaccuccggcggggugcuccugagccuguacgucuccgccucgcucuccuaccugcuguacagugacauccuccugaaguucuccccgaccgagaucaccgcccccaucaugccccuggacugcgcgaacgccagcaacgugcaggccgugaaucgcuccgccacgaagggcgucacccuccugcugcccgagccggaguggaccuacccccggcucucgugccccggguccaccuuccagaaggcccugcugaucagcccccaccgcuuuggcgagacgaaggggaacuccgcgccgcucaucauccgggagcccuucaucgccugcggccccaaggagugcaagcacuucgcccugacccacuaugccgcgcagcccggcggguacuacaacggcacccgcggggaccggaacaagcugcgccaccucaucagcgugaagcugggcaagaucccgaccguggagaauuccaucuuccacauggccgccuggucgggguccgccugccacgacggcaaggaguggacguauaucggcgucgacgggcccgacaacaacgcccugcucaagaucaaguacggcgaggcguacaccgacaccuaucacagcuacgccaacaacacccugcggacgcaggaguccgccugcaacuguaucgggggcaacugcuaccugaugaucaccgacggcucggccagcgggaucuccgagugucgcuuccucaagauccgggagggccgcaucaucaaggagaucuuccccaccgggcgggugaagcacaccgaggagugcacgugcggcuucgccagcaauaagaccaucgagugcgcgugccgcgacaacuccuacaccgccaagcggcccuucgugaagcugaaugucgagaccgacacggccgagauccgccugaugugcaccgagaccuaccucgacaccccgcggcccgacgacgggucgaucacgggccccugugaguccaacggcaacaaggggagcggcgggaucaagggcggguucgugcaccagcgcauggccuccaagaucggccggugguacagccgcaccauguccaagaccaagcggaugggcauggggcuguaugugaaguacgacggcgaccccuggaccgacucggacgcccuggcgcucuccggggucauggugaguauggaggagccgggcugguacuccuucggguucgagaucaaggacaagaagugcgacgugcccugcaucggcaucgagaugguccaugacggcgggaaggagacguggcacagcgccgccaccgccaucuacugccugaugggcuccgggcagcugcucugggacaccgugaccggcguggacauggcccuguga

SEQ ID NO: 30068 - RNA, 1401 nt, Artificial Sequence
  derived and/or modified CDS sequence (AUadapt) from InfluenzaB__AHL91468__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccagcaacgugcaggccgugaaccgcuccgccaccaagggcgucacccuccugcugcccgagccggaguggaccuacccccggcucucgugccccggguccacguuucagaaggcccugcugaucagcccccaccgcuucggcgagaccaaggggaacuccgcgccgcucaucauccgggagcccuucaucgccuguggccccaaggagugcaagcacuucgcccugacccacuacgccgcgcagcccggcggguacuauaacggcacccgcgaggaccggaacaagcugcgccaccucaucagcgugaagcuggggaagaucccgacgguggagaauuccaucuuccacauggccgccuggagcggcuccgccugccacgaugggaaggaguggaccuacaucggcgucgacggccccgacagcaacgcccugcucaagaucaaguacggggaggcguauaccgacaccuaccacuccuacgccaacaauauccugcggacgcaggagucggccugcaacugcaucggcgggaacugcuaucugaugaucaccgacggcagcgccuccggcaucagcgagugccgcuuccucaagauccgggaggggcgcaucaucaaggagaucuuucccaccggccgggugaagcacaccgaggagugcacgugcggguucgccuccaacaagaccaucgagugcgcgugucgcgacaacagcuacaccgccaagcggcccuucgugaagcugaaugucgagaccgacacggccgagauccgccugaugugcaccgagaccuaccucgacaccccgcggcccgacgauggcuccaucacggggcccugcgagagcaacggcgacaagggcuccgggggcaucaagggcggguucgugcaccagcgcauggccaguaagaucgggcggugguacucccgcaccaugagcaagaccaagcggaugggcaugggccuguacgugaaguacgacggggaucccuggaccgacuccgacgcccuggcgcucagcggcgucaugguguccgugggggagccgggcugguacagcuucggguuugagaucaaggacaagaagugcgacguccccugcaucggcaucgagauggugcacgauggcgggaaggagacguggcacuccgccgccaccgccaucuacugccugaugggcagcgggcagcugcucugggacaccgugaccggcgucgacauggcccuguga

SEQ ID NO: 30069 - RNA, 1401 nt, Artificial Sequence
  derived and/or modified CDS sequence (AUadapt) from InfluenzaB__AHL91479__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugcccucggacugcgcgaaugccuccaacgugcaggccgugaaccgcagcgccaccaagggcgucacccugcuccugcccgagccggaguggaccuacccccggcuguccugccccgggagcacguuucagaaggcccuccugaucagcccccaccgcuucggcgagaccaaggggaacuccgcgccgcugaucauccgggagcccuucaucgccugcggccccaaggaguguaagcacuucgcccucacccacuacgccgcgcagcccggcggguacuauaacggcacccgcggggaccggaacaagcugcgccaccugaucuccgugaagcucggcaagaucccgacgguggagaacucgaucuuucacauggccgccugguccgggagcgccugccacgacggcaaggaguggaccuacaucggcgucgaugggcccgacuccaacgcccugcugaagaucaaguacggcgaggcguacaccgacaccuaccauagcuacgccaacaacauccuccggacgcaggagagcgccugcaauugcaucgggggcaacugcuaccugaugaucaccgacggcuccgccagugggaucuccgagugccgcuuccugaagauccgggagggccgcaucaucaaggagaucuuccccaccgggcgggugaagcacaccgaggagugcacgugcggcuuugccagcaacaagaccaucgagugcgcgugccgcgacaacuccuauaccgccaagcggcccuucgugaagcucaacgucgagaccgacacggccgagauccgccugaugugcaccgagaccuaccuggacaccccgcggcccgaugacgggagcaucacgggccccugcgaguccaacggcgacaaggggaguggcgggaucaagggcggguucgugcaccagcgcauggccuccaagaucggccggugguacucgcgcaccauguccaagaccaagcggaugggcauggggcucuacgugaaguacgauggcgaccccuggaccgacagcgacgcccuggcgcuguccggggucauggugagcauggaggagccgggcugguacuccuuuggguucgagaucaaggacaagaagugcgacgugcccugcaucggcaucgagaugguccacgauggcgggaaggagacguggcacagcgccgccaccgccaucuacugccucaugggcuccgggcagcugcugugggacaccgugaccggcguggacauggcccucuga

SEQ ID NO: 30070 - RNA, 1401 nt, Artificial Sequence
  derived and/or modified CDS sequence (AUadapt) from InfluenzaB__AHL91501__NA
augcugcccaguaccauccagacccucacgcuguuccugaccuccggcggggugcuccugagccuguacgucuccgccucgcucuccuaccugcuguacagugacauccuccugaaguucuccccgaccgagaucaccgcccccacgaugccccuggacugcgcgaacgccagcaacgugcaggccgugaaucgcuccgccaccaagggcaugacccuccugcugcccgagccggaguggaccuacccccggcucucgugccccggguccacguuccagaaggcccugcugaucagcccccaccgcuuuggcgagaccaaggggaacuccgcgccgcucaucauccgggagcccuucaucgccugcggccccaaggagugcaagcacuucgcccugacccacuaugccgcgcagcccggcggguacuacaacggcacccgcgaggaccggaacaagcugcgccaccucaucagugucaagcuggggaagaucccgacgguggagaacuccaucuuccacauggccgccuggucgggcuccgccugccacgacgggaaggaguggaccuauaucggcguggacggccccgacagcaacgcccugcucaagaucaaguacggggaggcguacaccgauaccuaccacuccuacgccaacaacauccugcggacgcaggagagcgccugcaauugcaucggcgggaacugcuaccugaugaucaccgacggcucggccuccggcaucagcgagugucgcuuccucaagauccgggaggggcgcaucaucaaggagaucuuccccaccggccgggucgagcacaccgaggagugcacgugcggguucgccuccaauaagaccaucgagugcgcgugccgcgacaacagcuacaccgccaagcggcccuucgugaagcugaauguggagaccgacacggccgagauccgccugaugugcaccgagaccuaccucgacaccccgcggcccgacgacggcuccaucacggggcccugugagucgaacggcggcaagggguccggcgggaucaagggcggguucguccaccagcgcauggagagcaagaucggccggugguacucccgcaccaugagcaagaccaagcggaugggcauggggcuguaugugaaguacgacggcgaccccuggaccgacuccgacgcccuggcccucucgggggugauggucuccauggaggagccgggcugguauagcuucggguucgagaucaaggacaagaagugcgacgugcccugcaucggcaucgagauggugcaugacggcgggaaggagacguggcacuccgcggccaccgccaucuacugccugaugggcagcgggcagcugcucugggacaccgucaccggcgugaacauggcccuguga

SEQ ID NO: 30071 - RNA, 1401 nt, Artificial Sequence
  derived and/or modified CDS sequence (AUadapt) from InfluenzaB__AHL91512__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccucgaaugugcaggccgugaaccgcuccgccaccaagggcgucacccuccugcugcccgagccggaguggaccuacccccggcucagcugccccggguccaucuuccagaaggcccugcugaucagcccccaucgcuucggcgagacgaaggggaacuccgcgccgcucaucauccgggagcccuucaucgccugcggccccaaggagugcaagcacuuugcccugacccacuacgccgcgcagcccggcggguacuacaacggcacccgcggggaccggaauaagcugcgccaccucaucagcgugaagcugggcaagaucccgaccguggagaacuccaucuuccacauggccgccuggucgggguccgccugccaugacggcaaggaguggacguacaucggcgucgacgggcccgacagcaacgcccugcucaagaucaaguauggcgaggcguacaccgacaccuaccacuccuacgccaacaauauccugcggacccaggagagcgccugcaacugcaucgggggcaacugcuaucugaugaucacggacggcagcgccuccgggaucucggagugccgcuuccucaagauccgggagggccgcaucaucaaggagaucuuccccaccgggcgggugaagcauaccgaggagugcacgugcggcuucgccuccaacaagaccaucgagugcgcgugccgcgauaacagcuacaccgccaagcggcccuucgugaagcugaacgucgagaccgacaccgccgagauccgccugaugugcacggagaccuaucucgacaccccgcggcccgacgacggguccaucaccggccccugcgagagcaacggcgauaagggguccggcgggaucaagggcggguucgugcaccagcgcauggccagcaagaucggccggugguacucccgcacgaugucgaagaccaagcggaugggcauggggcuguacgugaaguaugacggcgaccccuggaccgacuccgacgcccuggcgcucagcggggucaugguguccauggaggagccgggcugguacaguuucggguucgagaucaaggacaagaagugcgacgugcccugcaucggcaucgagaugguccaugacggcgggaaggagaccuggcacuccgccgccacggccaucuacugccugaugggcagcgggcagcugcucugggacaccgugaccggcguggacauggcccuguga

SEQ ID NO: 30072 - RNA, 1401 nt, Artificial Sequence
  derived and/or modified CDS sequence (AUadapt) from InfluenzaB__AHL91523__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccgcuccgccaccaagggcgucacccuccugcugcccgagccggaguggaccuacccccggcucagcugccccggguccacguuccagaaggcccugcugaucucgccccaucgcuucggcgagaccaaggggaacuccgcgccgcucaucauccgggagcccuucaucgccugcggccccaaggagugcaagcacuuugcccugacccacuacgccgcgcagcccggcggguacuacaacggcacccgcggggaccggaauaagcugcgccaccucaucagcgugaagcugggcaagaucccgacgguggagaacuccaucuuccacauggccgccuggagcggguccgccugccaugacggcaaggaguggaccuacaucggcgucgacgggcccgacaacaacgcccugcucaagaucaaguauggcgaggcguacaccgacaccuaccacucguacgccaauaacauccugcggacgcaggaguccgccugcaacugcaucgggggcaacugcuaucugaugaucaccgacggcagcgccagcgggaucuccgagugccgcuuccucaagauccgggagggccgcaucaucaaggagaucuuccccaccgggcgggugaagcauaccgaggagugcacgugcggcuucgccucgaacaagaccaucgagugcgcgugucgcgacaacuccuacaccgccaagcggcccuucgugaagcugaacgucgagaccgacacggccgagauccgccugaugugcaccgagaccuaucucgacaccccgcggcccgacgacgggagcaucacgggccccugcgaguccaacggcgauaaggggagcggcgggaucaagggcggguucgugcaccagcgcauggccuccaagaucggccggugguacucgcgcaccauguccaagaccaagcggaugggcauggggcuguacgugaaguaugacggcgaccccuggaccgacagcgacgcccuggcgcucuccggggucauggugagcauggaggagccgggcugguauuccuucggguucgagaucaaggacaagaagugcgacgugcccugcaucggcaucgagaugguccaugacggcgggaaggagacguggcacagcgccgccaccgccaucuacugccugaugggcuccgggcagcugcucugggacaccgugaccggcguggacauggcccuguga

SEQ ID NO: 30073 - RNA, 1401 nt, Artificial Sequence; identical to SEQ ID NO: 30070
  derived and/or modified CDS sequence (AUadapt) from InfluenzaB__AHL91534__NA

SEQ ID NO: 30074 - RNA, 1401 nt, Artificial Sequence
  derived and/or modified CDS sequence (AUadapt) from InfluenzaB__AHL91545__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaaggagugcaagcauuucgcccugacccacuacgccgcgcagcccggcggguacuacaauggcacccgcggggaccggaacaagcugcgccaccucaucagcgugaagcugggcaagaucccgacgguggagaacuccaucuuccauauggccgccuggucgggguccgccugccacgacggcaaggaguggaccuacaucggcgucgacgggcccgauagcaacgcccugcucaagaucaaguacggcgaggcguacaccgacaccuaccauuccuacgccaacaacauccugcggacgcaggagagcgccugcaacuguaucgggggcaacugcuaccugaugaucaccgacggcagcgccuccgggaucagugagugccgcuuccucaagauccgggagggccgcaucaucaaggagaucuuccccaccgggcgggugaagcacaccgaggagugcacgugcggcuuugccuccaacaagaccaucgagugcgcgugccgcgacaacagcuauaccgccaagcggcccuucgugaagcugaacgucgagaccgacacggccgagauccgccugaugugcaccgagaccuaccucgacaccccgcggcccgaugacggguccaucacgggccccugcgagagcaacggcgacaagggguccggcgggaucaagggcggguuugugcaccagcgcaugaccagcaagaucggccggugguacucccgcaccaugucgaagaccaagcggaugggcauggggcuguacgugaaguacgauggcgaccccuggacggacuccgacgcccuggcccucagcggggucaugguguccauggaggagccgggcugguacagcuuuggguucgagaucaaggacaagaagugcgacgugcccugcaucggcaucgagaugguccacgauggcgggaagggcaccuggcacuccgcggccaccgccaucuacugccugauggggagcggccagcugcucugggacaccgugacgggcguggacauggcccuguga

SEQ ID NO: 30075 - RNA, 1401 nt, Artificial Sequence; identical to SEQ ID NO: 30070
  derived and/or modified CDS sequence (AUadapt) from InfluenzaB__AHL91556__NA

SEQ ID NO: 30076 - RNA, 1401 nt, Artificial Sequence; identical to SEQ ID NO: 30070
  derived and/or modified CDS sequence (AUadapt) from InfluenzaB__AHL91578__NA

SEQ ID NO: 30077 - RNA, 1401 nt, Artificial Sequence; identical to SEQ ID NO: 28998
  derived and/or modified CDS sequence (AUadapt) from InfluenzaB__AHL91589__NA

SEQ ID NO: 30078 - RNA, 1401 nt, Artificial Sequence
  derived and/or modified CDS sequence (AUadapt) from InfluenzaB__AHL91600__NA
augcugcccaguaccauccagacccucacgcuguuccugaccaccggcggggugcuccugucccuguacgucagcgccucccucagcuaccugcuguacuccgauauccuccugaaguucucgccgaccgagaucacggcccccaccaugccccuggacugcgcgaacgccuccaacgugcaggccgugaaucgcagcgccaccaagggcgucaccuuccuccugcccgagccggaguggacguacccccggcuguccugccccgggagcaccuuccagaaggcccuccugaucaguccccaccgcuucggcgagaccaaggggaacuccgcgccgcugaucauccgggagcccuucaucgccugcggccccaaggagugcaagcauuucgcccucacccacuacgccgcgcagcccggcggguacuacaacggcacgcgcggggaucggaacaagcugcgccaccugaucuccgugaagcucggcaagaucccgaccguggagaacucgaucuuccacauggccgccugguccgggagcgccugucacgacggcaaggaguggaccuacaucggcgucgacgggcccgacuccaacgcccugcugaagaucaaguauggcgaggcguacaccgacacguaccacagcuacgccaauaacauccuccggacccaggaguccgccugcaacugcaucgggggcaacugcuaucugaugaucaccgacggcagcgccucggggaucuccgagugccgcuuccugaagauccgggagggccgcaucaucaaggagaucuuccccaccgggcgggugaagcauacggaggagugcacgugcggcuucgccagcaacaagaccaucgagugcgcgugucgcgacaacuccuacaccgccaagcggcccuucgugaagcucaacgucgagaccgacaccgccgagauccgccugaugugcaccgagaccuaucuggacacgccgcggcccgacgacgggagcaucaccggccccugcgaguccaacggcgauaaggggagcggcgggaucaagggcggguucgugcaccagcgcauggccuccaagaucggccggugguacucgcgcaccauguccaagaccaagcggaugggcauggggcucuacgugaaguaugacggcgaccccuggacggacagcgacgcccuggcgcuguccggggucauggugagcauggaggagccgggcugguauuccuucggguucgagaucaaggacaagaagugcgacgugcccugcaucggcaucgagaugguccaugacggcgggaaggagaccuggcacagcgccgccaccgccaucuacugccucaugggcuccgggcagcugcugugggacaccgugacgggcguggacauggcccucuga

SEQ ID NO: 30079 - RNA, 1401 nt, Artificial Sequence; identical to SEQ ID NO: 30078
  derived and/or modified CDS sequence (AUadapt) from InfluenzaB__AHL91611__NA

SEQ ID NO: 30080 - RNA, 1401 nt, Artificial Sequence; identical to SEQ ID NO: 30070
  derived and/or modified CDS sequence (AUadapt) from InfluenzaB__AHL91622__NA

SEQ ID NO: 30081 - RNA, 1401 nt, Artificial Sequence; identical to SEQ ID NO: 30071
  derived and/or modified CDS sequence (AUadapt) from InfluenzaB__AHL91633__NA

SEQ ID NO: 30082 - RNA, 1401 nt, Artificial Sequence; identical to SEQ ID NO: 30071
  derived and/or modified CDS sequence (AUadapt) from InfluenzaB__AHL91644__NA

SEQ ID NO: 30083 - RNA, 1401 nt, Artificial Sequence
  derived and/or modified CDS sequence (AUadapt) from InfluenzaB__AHL91655__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccgcuccgccaccaaggaggucacccuccugcugcccgagccggaguggaccuacccccggcucagcugccccggcuccacguuccagaaggcccugcugaucucgccccaucgcuucggggagaccaagggcaacuccgcgccgcucaucauccgggagcccuucaucgccugcgggcccaaggagugcaagcacuuugcccugacccacuacgccgcgcagcccggcggcuacuacaacgggacccgcggcgaccggaauaagcugcgccaccucaucagcgugaagcuggggaagaucccgacgguggagaacuccaucuuccacauggccgccuggagcggcuccgccugccaugacgggaaggaguggaccuacaucggcgucgacggccccgacagcaacgcccugcucaagaucaaguauggggaggcguacaccgacaccuaccacuccuacgccaacaauauccugcggacgcaggagucggccugcaacugcaucggcgggaacugcuaucugaugaucaccgacggcagcgccuccggcaucagcgagugccgcuuccucaagauccgggaggggcgcaucaucaaggagaucuuccccaccggccgggugaagcauaccgaggagugcacgugcggguucgccuccaacaagaccaucgagugcgcgugccgcgauaacucguacaccgccaagcggcccuucgugaagcugaacgucgagaccgacacggccgagauccgccugaugugcaccgagaccuaucucgacaccccgcggcccgacgacggcuccaucacggggcccugcgagagcaacggcgauaagggcuccgggggcaucaagggcggguucgugcaccagcgcauggccagcaagaucgggcggugguacucccgcaccaugucgaagaccaagcggaugggcaugggccuguacgugaaguaugacggggaccccuggaccgacuccgacgcccuggcgcucagcggcgucaugguguccauggaggagccggggugguacaguuucggcuucgagaucaaggacaagaagugcgacgugcccugcaucgggaucgagaugguccaugacggcggcaaggagacguggcacuccgccgccaccgccaucuacugccugauggggagcggccagcugcucugggacaccgugaccgggguggacauggcccuguga

SEQ ID NO: 30084 - RNA, 1401 nt, Artificial Sequence; identical to SEQ ID NO: 30070
  derived and/or modified CDS sequence (AUadapt) from InfluenzaB__AHL91666__NA

SEQ ID NO: 30085 - RNA, 1401 nt, Artificial Sequence; identical to SEQ ID NO: 30071
  derived and/or modified CDS sequence (AUadapt) from InfluenzaB__AHL91677__NA

SEQ ID NO: 30086 - RNA, 1401 nt, Artificial Sequence; identical to SEQ ID NO: 30072
  derived and/or modified CDS sequence (AUadapt) from InfluenzaB__AHL91688__NA

SEQ ID NO: 30087 - RNA, 1401 nt, Artificial Sequence; identical to SEQ ID NO: 28800
  derived and/or modified CDS sequence (AUadapt) from InfluenzaB__AHL91699__NA

SEQ ID NO: 30088 - RNA, 1401 nt, Artificial Sequence
  derived and/or modified CDS sequence (AUadapt) from InfluenzaB__AHL91710__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccacuccgccaccaagggcgucacccuccugcugcccgagccggaguggaccuacccccgccucagcugccccggguccacguuccagaaggcccugcugaucaguccccaccgguucggcgagaccaaggggaacuccgcgccgcucaucauccgcgagcccuucaucgccugcggccccaaggagugcaagcauuucgcccugacccacuacgccgcgcagcccggcggguacuacaacggcacccgcggggaccggaauaagcugcggcaccucaucagcgugaagcugggcaagaucccgacgguggagaacuccaucuuccacauggccgccuggagcggguccgccugucacgacggcaaggaguggaccuacaucggcgucgacgggcccgacagcaaugcccugcucaagaucaaguacggcgaggcguacaccgacaccuaccacuccuacgccaauaacauccugcgcacgcaggagucggccugcaacugcaucgggggcaacugcuaucugaugaucaccgacggcagcgccuccgggaucagcgagugccgguuccucaagauccgcgagggccggaucaucaaggagaucuuccccaccgggcgcgugaagcauaccgaggagugcacgugcggcuucgccuccaacaagaccaucgagugcgcgugccgggauaacucguacaccgccaagcgccccuucgugaagcugaacgucgagaccgacacggccgagauccggcugauguguaccgagaccuaccucgacaccccgcgccccgacgacggguccaucacgggccccugcgagagcaacggcgauaagggguccggcgggaucaagggcggguucgugcaccagcggauggccagcaagaucggccgcugguacucccggaccaugucgaagaccaagcgcaugggcauggggcuguacgugaaguaugacggcgaccccuggaccgacuccgacgcccuggcgcucagcggggucaugguguccauggaggagccgggcugguacaguuucggguucgagaucaaggacaagaagugcgacgugcccugcaucggcaucgagaugguccaugacggcgggaaggagacguggcacuccgccgccaccgccaucuacugccugaugggcagcgggcagcugcucugggacaccgugaccggcguggacauggcccuguga

SEQ ID NO: 30089 - RNA, 1401 nt, Artificial Sequence; identical to SEQ ID NO: 28727
  derived and/or modified CDS sequence (AUadapt) from InfluenzaB__AHL91721__NA

SEQ ID NO: 30090 - RNA, 1401 nt, Artificial Sequence; identical to SEQ ID NO: 28795
  derived and/or modified CDS sequence (AUadapt) from InfluenzaB__AHL91732__NA

SEQ ID NO: 30091 - RNA, 1401 nt, Artificial Sequence; identical to SEQ ID NO: 28727
  derived and/or modified CDS sequence (AUadapt) from InfluenzaB__AHL91743__NA

SEQ ID NO: 30092 - RNA, 1401 nt, Artificial Sequence
  derived and/or modified CDS sequence (AUadapt) from InfluenzaB__AHL91754__NA
augcugcccaguaccauccagacccucacgcugcugcucaccuccggcggggugcugcugagccucuacgucuccgccagccuguccuaccugcucuacagugacauccugcugaaguucuccccgaccgagaucaccgcccccacgaugccccucgacugcgcgaacgccaguaacgugcaggccgugaaccgcuccgccaccaagggcgucacccugcugcuccccgagccggaguggaccuacccccggcugagcugccccggguccacguuccagaaggcccugcucaucaguccccaccgcuucggcgagaccaaggggaacuccgcgccgcugaucauccgggagcccuucaucgccugcggccccaaggaguguaagcacuucgcccugacccacuacgccgcgcagcccggcggguacuauaacggcacccgcggggaccggaacaagcuccgccaccugaucagcgugaagcugggcaagaucccgacgguggagaacuccaucuuucacauggccgccuggucgggguccgccugccacgacggcaaggaguggaccuauaucggcgucgacgggcccgacagcaacgcccuccugaagaucaaguacggcgaggcguauaccgacaccuaccacuccuacgccaacaacauccugcggacgcaggagagugccugcaacugcaucgggggcaacugcuaucucaugaucaccgacggcagcgccuccgggaucucggagugccgcuuccugaagauccgggagggccgcaucaucaaggagaucuuccccaccgggcgggugaagcauaccgaggagugcacgugcggcuucgccuccaacaagaccaucgagugcgcgugucgcgacaacagcuacaccgccaagcggcccuucgugaagcugaaugucgagaccgacacggccgagauccgccucaugugcaccgagaccuaccuggacaccccgcggcccgacgacggguccaucacgggccccugugagagcaacggcgacaagggguccggcgggaucaagggcggguucgugcaccagcgcauggccaguaagaucggccggugguacucccgcaccaugucgaagaccaagcggaugggcauggggcuguacgugaaguacgacggcgaucccuggaccgacuccgacgcccucgcgcugagcggggucaugguguccauggaggagccgggcugguacagcuucggguuugagaucaaggacaagaagugcgacgugcccugcaucggcaucgagaugguccacgauggcgggaaggagacguggcacuccgccgccaccgccaucuacugccugaugggcagcgggcagcuccugugggacaccgugaccggcguggacauggcccuguga

SEQ ID NO: 30093 - RNA, 1401 nt, Artificial Sequence; identical to SEQ ID NO: 28727
  derived and/or modified CDS sequence (AUadapt) from InfluenzaB__AHL91765__NA

SEQ ID NO: 30094 - RNA, 1401 nt, Artificial Sequence
  derived and/or modified CDS sequence (AUadapt) from InfluenzaB__AHL91776__NA
augcugcccaguaccauccagacccucacgcuguuccugaccuccggcggggugcuccugagccuguacgucuccgccagccucuccuaucugcuguacagcgacauccuccugaaguucuccccgaccgagaucaccgcccccacgaugccccuggacugugcgaacgccagcaacgugcaggccgugaaccgcuccgccaccaagggcgucacccuccugcugcccgagccggaguggaccuacccccggcucaguugccccggguccacguuccagaaggcccugcugaucagcccccaccgcuucggcgagaccaaggggaauuccgcgccgcucaucauccgggagcccuucaucgccugcggccccaaggagugcaagcacuuugcccugacccacuacgccgcgcagcccggcggguacuacaacggcacccgcggggaucggaacaagcugcgccaccucaucagcgugaagcugggcaagaucccgacgguggagaccuccaucuuccacauggccgccuggaguggguccgccugccacgacggcaaggaguggaccuacaucggcgucgacgggcccgauaacaacgcccugcucaagaucaaguacggcgaggcguacaccgauacguaccacucguacgccaacaauauccugcggacccaggaguccgccugcaacugcaucgggggcaacugcuaucugaugaucaccgacggcagcgccagcgggguguccgagugccgcuuccucaagauccgggagggccgcaucaucaaggagaucuuucccaccgggcgggugaagcacacggaggagugcacgugcggcuucgccaguaacaagaccaucgagugcgcgugccgcgacaacuccuauaccgccaagcggcccuucgucaagcugaacguggagaccgacaccgccgagauccgccugaugugcaccgagaccuaccucgauacgccgcggcccgacgacgggagcaucaccggccccugcgaguccaacggcgauaaggggagcggcgggaucaagggcggguucgugcaccagcgcauggccuccaagaucggccggugguacagucgcaccauguccaagaccgagcggaugggcauggggcuguacgucaaguacgacggcgaccccugggccgacagugacgcgcuggcccucuccggggugauggugagcauggaggagccgggcugguacuccuucggguucgagaucaaggauaagaagugcgacguccccugcaucggcaucgagauggugcacgacggcgggaaggagacguggcauagcgccgccaccgccaucuacugccugaugggcuccgggcagcugcucugggacaccgugaccggcgucgacauggcgcuguga

SEQ ID NO: 30095 - RNA, 1401 nt, Artificial Sequence; identical to SEQ ID NO: 30094
  derived and/or modified CDS sequence (AUadapt) from InfluenzaB__AHL91787__NA

SEQ ID NO: 30096 - RNA, 1401 nt, Artificial Sequence; identical to SEQ ID NO: 30094
  derived and/or modified CDS sequence (AUadapt) from InfluenzaB__AHL91798__NA

SEQ ID NO: 30097 - RNA, 1401 nt, Artificial Sequence; identical to SEQ ID NO: 28731
  derived and/or modified CDS sequence (AUadapt) from InfluenzaB__AHL91809__NA

SEQ ID NO: 30098 - RNA, 1401 nt, Artificial Sequence
  derived and/or modified CDS sequence (AUadapt) from InfluenzaB__AHL91820__NA
augcugcccaguaccauccagacccucacgcuguuccugaccuccggcggggugcuccugagccuguacgucuccgccagccucuccuaucugcuguacagcgacauccuccugaaguucuccccgaccgagaucaccgcccccacgaugccccuggacugugcgaacgccagcaacgugcaggccgugaaccgcuccgccaccaagggcgucacccuccugcugcccgagccggaguggaccuacccccggcucaguugccccggguccacguuccagaaggcccugcugaucagcccccaccgcuucggcgagaccaaggggaauuccgcgccgcucaucauccgggagcccuucaucgccugcggccccaacgagugcaagcacuuugcccugacccacuacgccgcgcagcccggcggguacuacaacggcacccgcggggaucggaacaagcugcgccaccucaucagcgugaagcugggcaagaucccgacgguggagaacuccaucuuccauauggccgccuggagcggguccgccugccacgacggcaaggaguggaccuauaucggcgucgacgggcccgacaacaacgcccugcucaagaucaaguacggcgaggcguauaccgacaccuaccacucguacgccaauaacauccugcggacgcaggaguccgccugcaacugcaucgggggcaacuguuaccugauggugaccgacggcagcgccagcgggguguccgagugccgcuuucucaagauccgggagggccgcaucaucaaggagaucuuccccaccgggcgggucaagcacaccgaggagugcacgugcggcuucgccaguaacaagaccaucgagugcgcgugccgcgacaacuccuauaccgccaagcggcccuucgugaagcugaacguggagaccgacacggccgagauccgccugaugugcaccgagaccuaucucgacaccccgcggcccgacgacgggagcaucacgggccccugcgaguccaauggcgacaaggggagcggcgggaucaagggcggguucguccaccagcgcauggccuccaagaucggccggugguacagucgcaccauguccaagaccgagcggaugggcauggggcuguacgugaaguacgacggcgaccccugggccgacagugacgcgcuggcccucuccggggugauggucagcauggaggagccgggcugguacuccuucggguucgagaucaaggauaagaagugcgacgugcccugcaucggcaucgagauggugcacgacggcgggaaggagaccuggcauagcgccgccacggccaucuacugccugaugggcuccgggcagcugcucugggacaccgucaccggcguggacauggcgcuguga

SEQ ID NO: 30099 - RNA, 1401 nt, Artificial Sequence
  derived and/or modified CDS sequence (AUadapt) from InfluenzaB__AHL91831__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccucgaacgugcaggccgugaaccgcuccgccaccaagggcgucacccuccugcugcccgagccggaguggaccuacccccggcucagcugccccggguccacguuucagaaggcccugcugaucagcccccaccgcuucggcgagaccaaggggaacuccgcgccgcucaucauccgggagcccuucaucgccuguggccccaacgagugcaagcacuucgcccugacccacuacgccgcgcagcccggcggguauuacaacggcacccgcggggaccggaacaagcugcgccaccucaucagugugaagcugggcaagaucccgacgguggagaacuccaucuuccacauggccgccuggagcggguccgccugccacgauggcaaggaguggaccuacaucggcgucgacgggcccgacaacaacgcccugcucaagaucaaguauggcgaggcguacaccgacaccuaccacucguacgccaauaacauccugcggacgcaggaguccgccugcaacugcaucgggggcaacuguuaccugaugaucaccgacggcagcgccagcgggguguccgagugccgcuuccucaagauccgggagggccgcaucaucaaggagaucuuucccaccgggcgggugaagcacaccgaggagugcacgugcggcuucgccagcaauaagaccaucgagugcgcgugccgcgacaacuccuacaccgccaagcggcccuucgucaagcugaauguggagaccgacacggccgagauccgccugaugugcaccgagaccuaccucgacaccccgcggcccgacgaugggagcaucacgggccccugcgaguccaacggcgacaaggggucgggcgggaucaagggcggguucgugcaucagcgcaugaccuccaagaucggccggugguacagccgcaccauguccaagaccgagcggaugggcauggggcuguacgucaaguacgacggcgaucccugggccgacagcgacgcccuggcgcucuccggggugauggugagcauggaggagccgggcugguacuccuucggguuugagaucaaggacaagaagugcgacguccccugcaucggcaucgagauggugcacgauggcgggaaggagacguggcacagcgccgccaccgccaucuacugccugaugggcuccgggcagcugcucugggacaccgugaccggcgucgacauggcccuguga

SEQ ID NO: 30100 - RNA, 1401 nt, Artificial Sequence; identical to SEQ ID NO: 29244
  derived and/or modified CDS sequence (AUadapt) from InfluenzaB__AHL91842__NA

SEQ ID NO: 30101 - RNA, 1401 nt, Artificial Sequence
  derived and/or modified CDS sequence (AUadapt) from InfluenzaB__AHL91853__NA
augcugcccaguaccauccagacccucacgcuguuccugaccuccggcggggugcuccugagccuguacgucuccgccucgcucuccuaccugcuguacagcgauauccuccugaaguucuccaccaccgagaucacggccccgaccaugcccagcgacugcgcgaacgccuccaacgugcaggccgugaaccgcagugccaccaagggcgucacccugcuccugcccgagcccgaguggacguacccgcggcuguccugccccgggagcaccuuccagaaggcccuccugaucucgccccaccgcuucggcgagaccaaggggaauuccgcgccccugaucauccgggagccguucaucgccugcggccccaaggagugcaagcacuucgcccucacccacuacgccgcgcagcccggcggguauuacaacggcacgcgcgaggaccggaacaagcugcgccaccugaucuccgugaagcucgggaagauccccaccguggagaacagcaucuuucacauggccgccugguccggcagcgccugccacgacgggaaggaguggaccuacaucggcgucgacggcccggauuccaacgcccugcugaagaucaaguacggggaggcguacaccgacacguaccacucguaugccaacaacauccuccggacccaggagagcgccugcaacugcaucggcgggaacugcuaucugaugaucaccgacggcuccgccucgggcaucuccgagugccgcuuccugaagauccgggaggggcgcaucaucaaggagaucuuccccaccggccgggugaagcacacggaggagugcacguguggguucgccagcaacaagaccaucgagugcgcgugccgcgacaacuccuauaccgccaagcggcccuucgugaagcucaacgucgagaccgacaccgccgagauccgccugaugugcaccgagaccuaccuggacacgccccggccggacgauggcagcaucaccgggcccugcgaguccaacggcaacaagggcucggggggcaucaagggcggguucgugcaccagcgcauggccuccaagaucgggcggugguauagccgcaccauguccaagaccaagcggaugggcaugggccucuacgugaaguacgacggggaccccuggacggacucggaugcccuggcgcuguccggcgucauggugagcauggaggagcccgggugguacuccuucggcuucgagaucaaggacaagaagugcgacgugccguguaucgggaucgagaugguccacgacggcggcaaggagaccuggcacagcgccgccaccgccaucuacugccucaugggguccggccagcugcugugggacaccgugacggggguggacauggcccucuga

SEQ ID NO: 30102 - RNA, 1401 nt, Artificial Sequence; identical to SEQ ID NO: 29242
  derived and/or modified CDS sequence (AUadapt) from InfluenzaB__AHL91864__NA

SEQ ID NO: 30103 - RNA, 1401 nt, Artificial Sequence; identical to SEQ ID NO: 29242
  derived and/or modified CDS sequence (AUadapt) from InfluenzaB__AHL91875__NA

SEQ ID NO: 30104 - RNA, 1401 nt, Artificial Sequence; identical to SEQ ID NO: 28999
  derived and/or modified CDS sequence (AUadapt) from InfluenzaB__AHL91886__NA

SEQ ID NO: 30105 - RNA, 1401 nt, Artificial Sequence; identical to SEQ ID NO: 28740
  derived and/or modified CDS sequence (AUadapt) from InfluenzaB__AHL91897__NA

SEQ ID NO: 30106 - RNA, 1401 nt, Artificial Sequence; identical to SEQ ID NO: 28740
  derived and/or modified CDS sequence (AUadapt) from InfluenzaB__AHL91908__NA

SEQ ID NO: 30107 - RNA, 1401 nt, Artificial Sequence
  derived and/or modified CDS sequence (AUadapt) from InfluenzaB__AHL91919__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaaugccucgaacgugcaggccgugaaccgcuccgccacgaagggcgucacgccccuccugcccgagccggaguggaccuacccccggcugagcugucccggguccaccuuccagaaggcccuccugaucagcccccaccgcuucggcgagaccaaggggaacuccgcgccgcugaucauccgggagcccuucaucgccuguggccccaaggagugcaagcacuucgcccucacccacuacgccgcgcagcccggcggguauuacaacggcacccgcgaggaccggaacaagcugcgccaccugaucagugugaagcucgggaagaucccgaccguggagaacuccaucuuccacauggccgccuggagcggcuccgccugccaugacgggcgggaguggacguacaucggcgucgacggccccgacucgaacgcccugcugaagaucaaguauggggaggcguacaccgacaccuaccacuccuacgccaagaauauccuccgcacccaggagagcgccugcaacugcaucggcggggacuguuaccugaugaucacggacggccccgccagcggcaucuccgagugccgguuccugaagauccgcgaggggcggaucaucaaggagaucuuucccaccggccgcgugaagcacaccgaggagugcacgugcggguucgccagcaacaagaccaucgagugugcgugccgggacaacuccuacaccgccaagcgcccguucgugaagcucaaugucgagaccgacaccgccgagauccggcugaugugcacggagaccuaccuggacacgccccgccccaacgauggcagcaucaccgggcccugcgaguccaacggcgacaagggcucggggggcaucaagggcggguuugugcaccagcggauggccuccaagaucgggcgcugguacagccggaccauguccaagaccaagcgcaugggcaugggccucuacgugaaguacgacggggauccguggaccgacagcgaggcccuggcgcuguccggcgucauggugagcauggaggagcccgggugguacuccuucggcuuugagaucaaggacaagaagugcgacgugcccugcaucgggaucgagaugguccacgauggcggcaagaccacguggcacagcgccgccaccgccaucuacugccucaugggguccggccagcugcugugggacaccgugaccgggguggacauggcccucuga

SEQ ID NO: 30108 - RNA, 1401 nt, Artificial Sequence; identical to SEQ ID NO: 29802
  derived and/or modified CDS sequence (AUadapt) from InfluenzaB__AHL91930__NA

SEQ ID NO: 30109 - RNA, 1401 nt, Artificial Sequence; identical to SEQ ID NO: 28740
  derived and/or modified CDS sequence (AUadapt) from InfluenzaB__AHL91941__NA

SEQ ID NO: 30110 - RNA, 1401 nt, Artificial Sequence; identical to SEQ ID NO: 28740
  derived and/or modified CDS sequence (AUadapt) from InfluenzaB__AHL91952__NA

SEQ ID NO: 30111 - RNA, 1401 nt, Artificial Sequence; identical to SEQ ID NO: 28783
  derived and/or modified CDS sequence (AUadapt) from InfluenzaB__AHL91963__NA

SEQ ID NO: 30112 - RNA, 1401 nt, Artificial Sequence
  derived and/or modified CDS sequence (AUadapt) from InfluenzaB__AHL91974__NA
augcugcccaguaccauccagacccucacgcuguuccugaccuccggcggggugcuccugagccuguacgucuccgccagccucuccuaccugcuguacagugacauccuccugaaguucuccccgaccgagaucaccacgcccaccaugccccuggacugcgccaacgcgagcaaugugcaggccgugaaccgcuccgccaccaagggcgucacccuccugcugcccgagccggaguggacguacccccggcucagcugccccggguccaccuuccagaaggcccugcugaucagcccccaccgcuuuggcgagaccaaggggaacuccgccccgcucaucauccgggagcccuucaucgcgugcggccccaacgagugcaagcacuuugcccugacccacuacgccgcccagcccggcggguacuacaacggcacgcgcggggaccggaauaagcugcgccaccucaucucggugaagcugggcaagaucccgaccguggagaacuccaucuuccacauggcggccuggagcggguccgccugccaugacggcaaggaguggaccuacaucggcgucgacgggcccgacaacaacgcccugcucaagaucaaguauggcgaggccuacaccgacacguaccacagcuacgcgaauaacauccugcggacccaggaguccgccugcaacugcaucgggggcaacugcuaccugaugaucaccgauggcagcgccucggggguguccgagugccgcuuccucaagauccgggagggccgcaucaucaaggagaucuuccccaccgggcgggugaagcacacggaggaguguacgugcggcuucgccagcaacaagaccaucgagugcgccugccgcgauaacuccuacaccgcgaagcggcccuucgucaagcugaacguggagaccgacaccgccgagauccgccugaugugcaccgacaccuaucucgacacgccgcggcccgacgacgggagcaucaccggccccugcgaguccaacggcgauaaggggagcggcgggaucaagggcggguucgugcaccagcgcauggccuccaagaucggccggugguacucgcgcaccauguccaagaccgagcggaugggcauggggcuguacgucaaguaugacggcgaccccugggccgacagcgacgcccuggcguucuccggggugauggugagcaugaaggagccgggcugguauuccuucggguucgagaucaaggacaagaagugcgacguccccugcaucggcaucgagauggugcaugacggcgggaaggagacguggcacagcgccgccaccgccaucuacugccucaugggcuccgggcagcugcugugggacaccgugaccggcgucgacauggcccucuga

SEQ ID NO: 30113 - RNA, 1401 nt, Artificial Sequence; identical to SEQ ID NO: 28783
  derived and/or modified CDS sequence (AUadapt) from InfluenzaB__AHL91985__NA

SEQ ID NO: 30114 - RNA, 1401 nt, Artificial Sequence; identical to SEQ ID NO: 28740
  derived and/or modified CDS sequence (AUadapt) from InfluenzaB__AHL91995__NA

SEQ ID NO: 30115 - RNA, 1401 nt, Artificial Sequence
  derived and/or modified CDS sequence (AUadapt) from InfluenzaB__AHL92006__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuucagaaggcccugcugaucucgccccaccgcuucggcgagaccaaggggaacuccgcgccgcucaucauccgggagcccuucaucgccugcggccccaaugagugcaagcacuucgcccugacccacuacgccgcgcagcccggcggguauuacaacggcacccgcggggaccggaacaagcugcgccaccucaucagcgugaagcugggcaagaucccgacgguggagaauuccaucuuccacauggccgccuggagcggguccgccugccacgauggcaaggaguggaccuacaucggcgucgacgggcccgacaacaacgcccugcucaagaucaaguacggcgaggcguauaccgacaccuaccacagcuacgccaauaagauccugcggacgcaggaguccgccugcaacugcaucgggggcaacugcuaccugaugaucaccgauggcagcgccagcgggguguccgagugccgcuuccucaagauccgggagggccgcaucaucaaggagaucuuccccaccgggcgggugaagcauaccgaggagugcacgugcggcuucgccucgaacaagaccaucgagugcgcgugucgcgacaacuccuacaccgccaagcggcccuucgucaagcugaacguggagaccgauacggccgagauccgccugaugugcaccgacaccuaccucgacaccccgcggcccgacgacgggaguaucacgggccccugcgaguccaacggcgacaaggggagcggcgggaucaagggcggguucgugcaucagcgcauggccuccaagaucggccggugguacagccgcaccauguccaagaccgagcggaugggcauggggcuguacgucaaguacgacggcgaccccugggccgauagcgacgcgcuggccuucuccggggugauggugagcaugaaggagccgggcugguacuccuuuggguucgagaucaaggacaagaagugcgacguccccugcaucggcguggagauggugcacgauggcgggaaggagaccuggcacagcgccgccacggccaucuacugccucaugggcuccgggcagcugcugugggacaccgucaccggcguggacauggcgcucuga

SEQ ID NO: 30116 - RNA, 1401 nt, Artificial Sequence; identical to SEQ ID NO: 28748
  derived and/or modified CDS sequence (AUadapt) from InfluenzaB__AHL92017__NA

SEQ ID NO: 30117 - RNA, 1401 nt, Artificial Sequence; identical to SEQ ID NO: 28748
  derived and/or modified CDS sequence (AUadapt) from InfluenzaB__AHL92028__NA

SEQ ID NO: 30118 - RNA, 1401 nt, Artificial Sequence
  derived and/or modified CDS sequence (AUadapt) from InfluenzaB__AHL92039__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaacgugcaugccgugaaccgcuccgccaccaagggcgucacccuccugcugcccgagccggaguggaucuacccccggcucagcugccccggguccaccuuccagaaggcccugcugaucagcccccaccgcuuuggcgagacgaaggggaacuccgcgccgcucaucauccgggagcccuucaucgccugcggccccaacgagugcaagcacuucgcccugacccauuacgccgcgcagcccggcggguacuacaacggcacccgcggggaccggaacaagcugcgccaccucaucagugugaagcugggcaagaucccgaccguggagaacuccaucuuccacauggccgccuggagcggguccgccugccacgacggcaaggaguggacguauaucggcgucgacgggcccgacaacaacgcccugcucaagaucaaguacggcgaggcguacaccgacaccuaucacagcuacgccaacaacauccugcggacccaggaguccgccugcaacuguaucgggggcaacugcuaccugaugaucacggacggcagcgccucggggguguccgagugucgcuuccucaagauccgggagggccgcaucaucaaggagaucuuccccaccgggcgggugaagcacaccgaggagugcacgugcggcuucgccagcaauaagaccaucgagugcgcgugccgcgacaacuccuacaccgccaagcggcccuucgucaagcugaacguggagaccgauaccgccgagauccgccugaugugcacggacaccuaccucgacaccccgcggcccgacgacgggagcaucaccggccccugugaguccaacggcgacaaggggagcggcgggaucaagggcggguucgugcaccagcgcauggccuccaagaucggccggugguacucgcgcacgauguccaagaccgagcggaugggcauggggcuguaugucaaguacaacggcgaccccugggccgacagcgacgcgcuggccuucuccggggugauggugaguaugaaggagccgggcugguacuccuucggguucgagaucaaggacaagaagugcgacguccccugcaucggcaucgagauggugcaugacggcgggaaggagaccuggcacagcgccgccaccgccaucuacugccucaugggcuccgggcagcugcugugggacacggugaccggcgucgacauggcgcucuga

SEQ ID NO: 30119 - RNA, 1401 nt, Artificial Sequence; identical to SEQ ID NO: 28748
  derived and/or modified CDS sequence (AUadapt) from InfluenzaB__AHL92050__NA

SEQ ID NO: 30120 - RNA, 1401 nt, Artificial Sequence
  derived and/or modified CDS sequence (AUadapt) from InfluenzaB__AHL92061__NA
augcugcccaguaccacccagacgcucacccuguuccugaccuccggcggggugcuccugagccuguacgucuccgccagccucuccuaccugcuguauagcgacauccuccugaaguucuccccgaccgagaucacggcccccaccaugccccuggacugcgcgaacgccaguaacgugcaggccgugaaccgcuccgccaccaagggcgucacccuccugcugcccgagccggaguggacguacccccggcucagcugccccggguccaccuuucagaaggcccugcugaucagcccccaccgcuucggcgagaccaaggggaacuccgcgccgcucaucauccgggagcccuucaucgccugcggccccaaugagugcaagcacuucgcccugacccacuacgccgcgcagcccggcggguauuacaacggcacgcgcggggaccggaacaagcugcgccaccucaucagcgugaagcugggcaagaucccgaccguggagaauuccaucuuccacauggccgccuggagcggguccgccugccacgauggcaaggaguggaccuacaucggcgucgacgggcccgacaacaacgcccugcucaagaucaaguacggcgaggcguauaccgacacguaccacucguacgccaauaagauccugcggacccaggaguccgccugcaacugcaucgggggcaacugcuaccugaugaucaccgauggcagcgccagcgggguguccgagugccgcuuccucaagauccgggagggccgcaucaucaaggagaucuuccccaccgggcgggugaagcauacggaggagugcacgugcggcuucgccagcaacaagaccaucgagugcgcgugucgcgacaacuccuacaccgccaagcggcccuucgucaagcugaacguggagaccgauaccgccgagauccgccugaugugcaccgacaccuaccucgacacgccgcggcccgacgacgggaguaucaccggccccugcgaguccaacggcgacaaggggucgggcgggaucaagggcggguucgugcaucagcgcauggccuccaagaucggccggugguacagccgcaccauguccaagaccgagcggaugggcauggggcuguacgucaaguacgacggcgaccccugggccgauagcgacgcgcuggccuucuccggggugauggugagcaugaaggagccgggcugguacuccuuuggguucgagaucaaggacaagaagugcgacguccccugcaucggcaucgagauggugcacgauggcgggaaggagacguggcacagcgccgccaccgccaucuacugccucaugggcuccgggcagcugcugugggacaccgugaccggcgucgacauggcgcucuga

SEQ ID NO: 30121 - RNA, 1401 nt, Artificial Sequence
  derived and/or modified CDS sequence (AUadapt) from InfluenzaB__AHL92072__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccacuccgccaccaagggcgucacccuccugcugcccgagccggaguggaccuacccccgccucagcugccccggguccacguuccagaaggcccugcugaucagcccccaucgguucggcgagaccaaggggaacuccgcgccgcucaucauccgcgagcccuucaucgccugcggccccaacgagugcaagcauuucgcccugacccacuacgccgcgcagcccggcggguacuacaacggcacccgcggggaucggaacaagcugcggcaccucaucucggugaagcugggcaagaucccgacgguggagaacuccaucuuccacauggccgccuggagcggguccgccugucacgacggcaaggaguggaccuacaucggcgucgacgggcccgacaacaaugcccugcucaagaucaaguacggcgaggcguacaccgacaccuaccacagcuaugccaacaagauccugcgcacgcaggaguccgccugcaacugcaucgggggcaacugcuaccugaugaucaccgauggcagcgccucggggguguccgagugccgguuccucaagauccgcgagggccggaucaucaaggagaucuuccccaccgggcgcgugaagcacaccgaggaguguacgugcggcuucgccagcaacaagaccaucgagugcgcgugccgggauaacuccuacaccgccaagcgccccuucgucaagcugaacguggagaccgacacggccgagauccggcugaugugcaccgacaccuaucucgacaccccgcgccccgacgacgggagcaucacgggccccugcgaguccaacggcgauaaggggagcggcgggaucaagggcggguucgugcaccagcggauggccuccaagaucggccgcugguacucgcggaccauguccaagaccgagcgcaugggcauggggcuguacgucaaguaugacggcgaccccugggccgacagcgacgcgcuggccuucuccggggugauggugagcaugaaggagccgggcugguauuccuucggguucgagaucaaggacaagaagugcgacguccccugcaucggcaucgagauggugcaugacggcgggaaggagaccuggcacagcgccgccacggccaucuacugccucaugggcuccgggcagcugcugugggacaccgugaccggcgucgacauggcgcucuga

SEQ ID NO: 30122 - RNA, 1401 nt, Artificial Sequence; identical to SEQ ID NO: 30121
  derived and/or modified CDS sequence (AUadapt) from InfluenzaB__AHL92083__NA

SEQ ID NO: 30123 - RNA, 1401 nt, Artificial Sequence; identical to SEQ ID NO: 30121
  derived and/or modified CDS sequence (AUadapt) from InfluenzaB__AHL92094__NA

SEQ ID NO: 30124 - RNA, 1401 nt, Artificial Sequence
  derived and/or modified CDS sequence (AUadapt) from InfluenzaB__AHL92105__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccagcaacgugcacgccgugaaccgcuccgccaccaagggcgucacccuccugcugcccgagccggaguggaccuacccccggcucaguugccccggguccacguuccagaaggcccugcugaucucgccccaccgcuucggcgagaccaaggggaacuccgcgccgcucaucauccgggagcccuuuaucgccugcggccccaacgagugcaagcacuucgcccugacccauuacgccgcgcagcccggcggguacuacaacggcacccgcggggaccggaauaagcugcgccaccucaucagcgugaagcugggcaagaucccgacgguggagaacuccaucuuccacauggccgccuggagcggguccgccugucacgacggcaaggaguggaccuacaucggcgucgacgggcccgacaauaacgcccugcucaagaucaaguacggcgaggcguacaccgacaccuaccauagcuacgccaacaacauccugcggacgcaggaguccgccugcaacuguaucgggggcaacugcuaccugaugaucaccgacggcagcgccagugggguguccgagugccgcuuccucaagauccgggagggccgcaucaucaaggagaucuuccccaccgggcgggugaagcacaccgaggagugcacguguggcuucgccucgaacaagaccaucgagugcgcgugccgcgauaacuccuacaccgccaagcggcccuucgucaagcugaacguggagaccgacacggccgagauccgccugaugugcaccgauaccuaccucgacaccccgcggcccgacgacgggagcaucacgggccccugugaguccaacggcgacaagggcggcgggggcaucaagggcggguucgugcaccagcgcauggccagcaagaucgggcggugguauucccgcaccaugagcaagaccgagcggauggggaugggccuguacgucaaguacgacggggaccccugggccgacuccgaugcgcuggccuucagcggcgugauggugucccucaaggagccggggugguacagcuucggcuuugagaucaaggacaagaagugcgacguccccugcaucggcaucgagauggugcacgaugggggcaaggagaccuggcacuccgccgccacggccaucuacugccugauggggagcggccagcugcucugggacaccgugaccggcgucgacauggcgcuguga

SEQ ID NO: 30125 - RNA, 1401 nt, Artificial Sequence; identical to SEQ ID NO: 28901
  derived and/or modified CDS sequence (AUadapt) from InfluenzaB__AHL92116__NA

SEQ ID NO: 30126 - RNA, 1401 nt, Artificial Sequence; identical to SEQ ID NO: 30121
  derived and/or modified CDS sequence (AUadapt) from InfluenzaB__AHL92127__NA

SEQ ID NO: 30127 - RNA, 1401 nt, Artificial Sequence; identical to SEQ ID NO: 30121
  derived and/or modified CDS sequence (AUadapt) from InfluenzaB__AHL92138__NA

SEQ ID NO: 30128 - RNA, 1401 nt, Artificial Sequence; identical to SEQ ID NO: 30121
  derived and/or modified CDS sequence (AUadapt) from InfluenzaB__AHL92149__NA

SEQ ID NO: 30129 - RNA, 1401 nt, Artificial Sequence
  derived and/or modified CDS sequence (AUadapt) from InfluenzaB__AHL92171__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccacuccgccaccaagggcgucacccuccugcugcccgagccggaguggaccuacccccgccucagcugccccggguccacguuucagaaggcccugcuggugagcccccaccgguucggcgagaccaaggggaacuccgcgccgcucaucauccgcgagcccuucaucgccugcggccccaaugagugcaagcacuucgcccugacccacuacgccgcgcagcccggcggguacuauaacggcacccgcggggaccggaacaagcugcggcaccucaucagcgugaagcugggcaagaucccgacggucgagaacuccaucuuucacauggccgccuggagcggguccgccugccacgacggcaaggaguggaccuacaucggcguggaugggcccgacaacaacgcccugcucaagaucaaguacggcgaggcguacaccgacaccuaucacucguacgccaacaagauccugcgcacgcaggaguccgccugcaacuguaucgggggcaacugcuaccugaugaucaccgacggcagcgccagcgggguguccgagugucgguuccucaagauccgcgagggccggaucaucaaggagaucuuccccaccgggcgcgucaagcacaccgaggagugcacgugcggcuucgccaguaacaagaccaucgagugcgcgugccgggacaacuccuacaccgccaagcgccccuuugugaagcugaacguggagaccgacacggccgagauccggcugaugugcaccgacaccuaccucgacaccccgcgccccgaugacgggagcaucacgggccccugcgaguccaacggcgacaaggggucgggcgggaucaagggcggguuuguccaccagcggauggccuccaagaucggccgcugguacagccggaccauguccaagaccgagcgcaugggcauggggcuguacgugaaguacgacggcgaucccugggccgacagcgacgcgcuggccuucuccggggugauggucagcaugaaggagccgggcugguacuccuuuggguucgagaucaaggacaagaagugcgacgugcccugcaucggcaucgagauggugcacgauggcgggaaggagaccuggcacagcgccgccacggccaucuacugccucaugggcuccgggcagcugcugugggacaccgucaccggcguggacauggcgcucuga

SEQ ID NO: 30130 - RNA, 1401 nt, Artificial Sequence
  derived and/or modified CDS sequence (AUadapt) from InfluenzaB__AHL92182__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccagcaacgugcacgccgugaaccgcuccgccaccaagggcgucacccuccugcugcccgagccggagugggccuacccccggcucaguugccccggguccaccuuccagaaggcgcugcugaucagcccccaccgcuucggcgagacgaaggggaacuccgccccgcucaucauccgggagcccuuuaucgccugcggccccaacgagugcaagcacuucgcccugacccauuacgcggcccagcccggcggguacuacagcggcacccgcggggaccggaauaagcugcgccaccucaucuccgugaagcugggcaagaucccgaccguggagaacagcaucuuccacauggccgccugguccgggagcgccugucacgacggcaaggaguggacguacaucggcgucgacgggcccgacaauaacgcgcugcucaagaucaaguacggcgaggccuacaccgacaccuaccauuccuacgccaacaacauccugcggacccaggagucggccugcaacuguaucgggggcaacugcuaccugaugaucacggacggcagcgccuccggggugagugagugccgcuuccucaagauccgggagggccgcaucaucaaggagaucuuccccaccgggcgggugaagcacaccgaggagugcacguguggcuucgcguccaacaagaccaucgagugcgccugccgcgacaauagcuacaccgccaagcggcccuucgucaagcugaacguggagaccgacaccgccgagauccgccugaugugcacggauaccuaccucgacaccccgcggcccgacgacggguccaucaccggccccugcgagaguaacggcgacaagggguccggcgggaucaagggcggguucgugcaccagcgcauggccagcaagaucggccggugguauucccgcacgaugagcaagaccgagcggaugggcauggggcuguacgucaaguacgacggcgaccccugggcggacuccgaugcccuggccuucagcggggugaugguguccaugaaggagccgggcugguacagcuucggguuugagaucaaggacaagaagugcgacguccccugcaucggcaucgagauggugcacgauggcgggaaggagaccuggcacuccgccgccaccgcgaucuacugccucaugggcagcgggcagcugcugugggacacggugaccggcgucgacauggcccucuga

SEQ ID NO: 30131 - RNA, 1401 nt, Artificial Sequence; identical to SEQ ID NO: 30130
  derived and/or modified CDS sequence (AUadapt) from InfluenzaB__AHL92193__NA

SEQ ID NO: 30132 - RNA, 1401 nt, Artificial Sequence; identical to SEQ ID NO: 28901
  derived and/or modified CDS sequence (AUadapt) from InfluenzaB__AHL92204__NA

SEQ ID NO: 30133 - RNA, 1401 nt, Artificial Sequence
  derived and/or modified CDS sequence (AUadapt) from InfluenzaB__AHL92215__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaacgugcaggccgugaaucacuccgccaccaagggcgucacccuccugcugcccgagccggaguggaccuacccccgccucagcugccccggguccacguuccagaaggcccugcugaucucgccccaccgguuuggcgagaccaaggggaacuccgcgccgcucaucauccgcgagcccuucaucgccugcggccccaacgagugcaagcacuucgcccugacccauuacgccgcgcagcccggcggguacuacaacggcacccgcggggaccggaacaagcugcggcaccucaucagugugaagcugggcaagaucccgacgguggagaacuccaucuuccacauggccgccuggagcggguccgccugccacgauggcaaggaguggaccuacaucggcgucgacgggcccgacaacaacgcccugcucaagaucaaguacggcgaggcguacaccgauaccuaccacucguacgccaacaagauccugcgcacgcaggaguccgccugcaacuguaucgggggcaacugcuaccugaugaucaccgacggcagcgccagcgggguguccgagugccgguuucucaagauccgcgagggccggaucaucaaggagaucuuccccaaggggcgcgugaagcacaccgaggagugcacgugcggcuucgccucgaacaagaccaucgagugugcgugccgggacaacuccuacaccgccaagcgccccuucgucaagcugaacguggagaccgauaccgccgagauccggcugaugugcacggacaccuaccucgacaccccgcgccccgacgacgggagcaucaccggccccugugaguccaacggcgacaaggggagcggcgggaucaagggcggguucgugcaccagcggauggccuccaagaucggccgcugguacucgcggacgauguccaagaccgagcgcaugggcauggggcuguaugucaaguacgacggcgaccccugggccgacagcgacgcgcuggccuucuccggggugauggugaguaugaaggagccgggcugguacuccuucggguucgagaucaaggacaagaagugcgacguccccugcaucggcaucgagauggugcaugacggcgggaaggagaccuggcacagcgccgccaccgccaucuacugccucaugggcuccgggcagcugcugugggacacggugaccggcgucgacauggcgcucuga

SEQ ID NO: 30134 - RNA, 1401 nt, Artificial Sequence; identical to SEQ ID NO: 30121
  derived and/or modified CDS sequence (AUadapt) from InfluenzaB__AHL92226__NA

SEQ ID NO: 30135 - RNA, 1401 nt, Artificial Sequence; identical to SEQ ID NO: 28901
  derived and/or modified CDS sequence (AUadapt) from InfluenzaB__AHL92237__NA

SEQ ID NO: 30136 - RNA, 1401 nt, Artificial Sequence; identical to SEQ ID NO: 30121
  derived and/or modified CDS sequence (AUadapt) from InfluenzaB__AHL92248__NA

SEQ ID NO: 30137 - RNA, 1401 nt, Artificial Sequence
  derived and/or modified CDS sequence (AUadapt) from InfluenzaB__AHL92259__NA
augcugcccaguaccauccagacccucacgcuguuccugaccuccggcggggugcuccugagccuguacgucuccgccagccucuccuaccugcuguacagugacauccuccugaaguucuccccgaccgagaucaccgccucgacgaugccccuggacugcgcgaacgccuccaaugugcaggccgugaaccgcagcgccaccaagggcgucacccuccugcugcccgagcccgaguggaccuacccgcggcucuccugccccgggagcacguuccagaaggcccugcugaucagcccccaucgcuucggcgagaccaaggggaacuccgcgccccucaucauccgggagccguucaucgccugcggccccaacgagugcaagcauuucgcccugacccacuacgccgcgcagcccggcggguacuacaacggcacccgcggggaucggaacaagcugcgccaccucaucuccgugaagcugggcaagauccccacgguggagaacucgaucuuccacauggccgccugguccgggagcgccugucacgacggcaaggaguggaccuacaucggcgucgacgggccggacaacgaugcccugcucaagaucaaguacggcgaggcguacaccgacaccuaccacuccuacgccaauaagauccugcggacgcaggagagcgccugcaacugcaucgggggcaacugcuaccugaugaucaccgauggcagcgccuccggggugucggagugccgcuuccucaagauccgggagggccgcaucaucaaggagaucuuccccaccgggcgggugaagcacaccgaggaguguacgugcggcuucgccuccaacaagaccaucgagugcgcgugccgcgacaauagcuacaccgccaagcggcccuucgucaagcugaacguggagaccgacacggccgagauccgccugaugugcaccgacaccuaucucgacacgccccggccggacgacggguccaucaccggccccugcgagagcaacggcgauaagggguccggcgggaucaagggcggguucgugcaccagcgcaugaccagcaagaucggccggugguacucccgcaccaugucgaagaccgagcggaugggcauggggcuguacgucaaguaugacggcgaccccugggccgacuccgacgcccuggcguucagcggggugaugguguccaugaaggagcccggcugguacaguuucggguucgagaucaaggacaagaagugcgacgucccgugcaucggcaucgagauggugcaugacggcgggaaggagacguggcacuccgccgccaccgccaucuacugccucaugggcagcgggcagcugcugugggacaccgugaccggcgucgacauggcccucuga

SEQ ID NO: 30138 - RNA, 1401 nt, Artificial Sequence; identical to SEQ ID NO: 30121
  derived and/or modified CDS sequence (AUadapt) from InfluenzaB__AHL92270__NA

SEQ ID NO: 30139 - RNA, 1401 nt, Artificial Sequence
  derived and/or modified CDS sequence (AUadapt) from InfluenzaB__AHL92281__NA
augcugcccaguaccauccagacccucacgcuguuccugaccuccggcggggugcuccugagccuguacgucuccgccagccucuccuaccugcuguauucggacauccuccugaaguucuccccgaccgagaucaccgcccccacgaugccccuggacugcgcgaacgccaguaacgugcaggccgccaaccacuccgccaccaagggcgugacccuccugcugcccgagccggaguggaccuacccccgccucagcugccccggguccacguuucagaaggcgcugcugaucagcccccaccgguucggcgagaccaaggggaacuccgccccgcucaucauccgcgagcccuucaucgccugcggccccaaugagugcaagcacuucgcccugacccacuacgcggcccagcccggcggguacuauaacggcacccgcggggaccggaacaagcugcggcaccucaucucggucaagcugggcaagaucccgacgguggagaacuccaucuuucacauggccgccuggagcggguccgccugccacgacggcaaggaguggaccuacaucggcguggaugggcccgacaacaacgcgcugcucaagaucaaguacggcgaggccuacaccgacaccuaucacagcuacgccaacaagauccugcgcacgcaggaguccgccugcaacuguaucgggggcaacugcuaccugaugaucaccgacggcagcgccucgggggucuccgagugucgguuccucaagauccgcgagggccggaucaucaaggagaucuuccccaccgggcgcgugaagcacaccgaggagugcacgugcggcuucgcgaguaacaagaccaucgagugcgccugccgggacaacuccuacaccgccaagcgccccuuugugaagcugaacgucgagaccgacacggccgagauccggcugaugugcaccgacaccuaccucgacaccccgcgccccgaugacgggagcaucacgggccccugcgaguccaacggcgacaaggggagcggcgggaucaagggcggguuugugcaccagcggauggccuccaagaucggccgcugguacucgcggaccauguccaagaccgagcgcaugggcauggggcuguacgugaaguacgacggcgaucccugggcggacagcgacgcccuggccuucuccggggucauggugagcaugaaggagccgggcugguacuccuuuggguucgagaucaaggacaagaagugcgacgugcccugcaucggcaucgagaugguccacgauggcgggaaggagaccuggcacagcgccgccacggcgaucuacugccucaugggcuccgggcagcugcugugggacaccgugaccggcguggacauggcccucuga

SEQ ID NO: 30140 - RNA, 1401 nt, Artificial Sequence
  derived and/or modified CDS sequence (AUadapt) from InfluenzaB__AHL92303__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaacgugcaugccgugaaccgcuccgccaccaagggcgucaccuuccuccugcccgagccggaguggaccuacccccggcugagcugccccggguccacguuccagaaggcccuccugaucagcccccaucgcuucggcgagaccaaggggaacuccgcgccgcugaucauccgggagcccuucaucgccugcggccccaacgagugcaagcacuuugcccucacccacuacgccgcgcagcccggcggguacuacaacggcacccgcggggaccggaacaagcugcgccaucugaucucggugaagcucggcaagaucccgacgguggagaacuccaucuuccacauggccgccuggagcggguccgccugccacgauggcaaggaguggaccuacaucggcgucgacgggcccgacaacaacgcccugcugaagaucaaguacggcgaggcguacaccgauaccuaccacagcuacgccaacaacauccuccggacgcaggaguccgccugcaauugcaucgggggcaacugcuaccugaugaucaccgacggcagcgccucggggguguccgagugucgcuuccugaagauccgggagggccgcaucaucaaggagaucuuccccaccgggcgggugaagcacaccgaggagugcacgugcggcuucgccagcaauaagaccaucgagugcgcgugccgcgacaacuccuacaccgccaagcggcccuucgucaagcucaacguggagaccgauacggccgagauccgccugaugugcaccgacaccuaccuggacaccccgcggcccgacgacgggagcaucacgggccccugugaguccaacggcaacaaggggagcggcgggaucaagggcggguucgugcaccagcgcauggccuccaagaucggccggugguacucgcgcaccauguccaagaccgagcggaugggcauggggcucuaugucaaguacgacggcgaccccugggccgacagcgacgcgcuggccuucuccggggugauggugaguaugaaggagccgggcugguacuccuucggguucgagaucaaggacaagaagugcgacguccccugcaucggcaucgagauggugcaugacggcgggaaggagaccuggcacagcgccgccacggccaucuacugccugaugggcuccgggcagcuccugugggacaccgugaccggcgucgacauggcgcuguga

SEQ ID NO: 30141 - RNA, 1401 nt, Artificial Sequence
  derived and/or modified CDS sequence (AUadapt) from InfluenzaB__AHL92314__NA
augcugcccaguaccauccagacccucacgcuguuccugaccuccggcggggugcuccugagccuguacgucuccgccagccucuccuaccugcuguauagcgacauccuccugaaguucucccagaccaagaucaccgccccgaucaugccccuggacugcgcgaaugccagcaacgugcaggccgugaaccgcuccgccgccaagggcgucacgcuccugcugcccgagcccgaguggaccuacccgcggcucagcugucccggguccaccuuccagaaggcgcugcugaucucgccccaccgcuucggcgagaccaaggggaacuccgcgccccucaucauccgggagccguucaucgccuguggccccacggagugcaagcacuucgcccugacccacuacgccgcccagcccggcggguauuacaacggcacccgcgaggaccggaacaagcugcgccaccucaucagugugaagcuggggaagauccccaccguggagaacuccaucuuccacauggccgccuggagcggcuccgccugccacgaugggaaggaguggacguacgucggcguggacggcccggacagcaacgcgcugcucaagaucaaguauggggaggccuacaccgacaccuaccacuccuacgccaagaauauccugcggacccaggagagcgccugcaacugcaucggcggggacugcuaucugaugaucacggacggccccgccagcggcaucuccgagugccgcuuccucaagauccgggaggggcgcaucaucaaggagaucuuccccaccggccgggugaagcauaccgaggagugcacgugcggguucgcgucgaacaagaccaucgagugugccugccgcgacaacuccuacaccgccaagcggcccuucgucaagcugaacguggagaccgauaccgccgagauccgccugaugugcacggagaccuaccucgacaccccgcggcccaacgacggcaguaucaccgggcccugcgaguccgacggcgacaagggcagcgggggcaucaagggcggguucgugcaucagcgcauggccuccaagaucgggcggugguacagccgcacgauguccaagaccaagcggaugggcaugggccuguacgucaaguacgacggggaccccuggaccgauagcgaggcgcuggcccucuccggcgugauggugagcauggacgagccggggugguacuccuucggcuuugagaucaaggacaagaagugcgacguccccugcaucgggaucgagauggugcacgauggcggcaagaccacguggcacagcgccgccaccgccaucuacugccugaugggguccggccagcugcucugggacaccgugaccggggucgacauggcgcuguga

SEQ ID NO: 30142 - RNA, 1401 nt, Artificial Sequence
  derived and/or modified CDS sequence (AUadapt) from InfluenzaB__AHL92325__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgaucaugccccuggacugugcgaacgccagcaacgugcaggccgugaaccgcuccgccgccaagggcgucacgcuccugcugcccgagcccgaguggaccuacccgcggcucaguugccccggguccaccuuccagaaggcgcugcugaucagcccccaccgcuucggcgagaccaaggggaauuccgcgccccucaucauccgggagccguucaucgccugcggccccacggagugcaagcacuucgcccugacccauuacgccgcccagcccggcggguacuacaacggcacccgcgaggaccggaauaagcugcgccaccucaucagcgugaagcuggggaagauccccaccguggagaacuccaucuuccacauggccgccuggaguggcuccgccugccacgacgggaaggaguggacguacaucggcgucgacggcccggauucgaacgcgcugcucaagaucaaguacggggaggccuacaccgacaccuaucacuccuacgccaagaacauccugcggacccaggagagcgccugcaauugcaucggcggggacugcuaccugaugaucacggacggccccgccaguggcaucuccgagugccgcuuccucaagauccgggaggggcgcaucaucaaggagaucuuccccaccggccgggugaagcacaccgaggagugcacguguggguucgcgagcaacaagaccaucgagugcgccugccgcgauaacuccuacaccgccaagcggcccuucgugaagcugaacgucgagaccgacaccgccgagauccgccugauguguacggagaccuaccucgacaccccgcggcccaacgacggcagcaucaccgggcccugugaguccgacggcgacaagggcagcgggggcaucaagggcggguucgugcaccagcgcauggccuccaagaucgggcggugguauagccgcacgauguccaagaccaagcggaugggcaugggccuguacgugaaguacgacggggaccccuggaccgauagcgaggcgcuggcccucuccggcgucauggugagcaugggggagccgggcugguacuccuucggguucgagaucaaggauaagaagugcgacgugcccugcaucggcaucgagaugguccacgacggcgggaagaccacguggcauagcgccgccaccgccaucuacugccugaugggcuccgggcagcugcucugggacaccgugaccggcguggacauggcgcuguga

SEQ ID NO: 30143 - RNA, 1401 nt, Artificial Sequence; identical to SEQ ID NO: 28901
  derived and/or modified CDS sequence (AUadapt) from InfluenzaB__AHL92336__NA

SEQ ID NO: 30144 - RNA, 1401 nt, Artificial Sequence
  derived and/or modified CDS sequence (AUadapt) from InfluenzaB__AHL92358__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaaugccagcaacgugcaggccgugaaccgcuccgccgccaagggcgucacgcuccugcugcccgagcccgaguggaccuacccgcggcucagcugucccggguccaccuuccagaaggcgcugcugaucucgccccaccgcuucggcgagaccaaggggaacuccgcgccccucaucauccgggagccguucaucgccuguggccccaaggagugcaagcacuucgcccugacgcacuacgccgcccagcccggcggguauuacaacggcacccgcgaggaccggaacaagcugcgccaccucaucagugugaagcuggggaagauccccaccguggagaacuccaucuuccacauggccgccuggagcggcuccgccugccaugacgggaaggaguggaccuacgucggcguggacggcccggacagcaacgcgcugcucaagaucaaguauggggaggccuacacggacaccuaccacuccuacgccaagaauauccugcggacccaggagagcgccugcaacugcaucggcggggacuguuaccugaugaucaccgacggccccgccagcggcaucuccgagugccgcuuccucaagauccgggaggggcgcaucaucaaggagaucuuucccacgggccgggugaagcacaccgaggagugcacgugcggguucgcgucgaacaagaccaucgagugugccugccgcgacaacuccuacaccgccaagcggcccuucgucaagcugaauguggagaccgacaccgccgagauccgccugaugugcaccgagacguaccucgacaccccgcggcccaacgauggcagcaucaccgggcccugcgaguccgacggcgacaagggcagcgggggcaucaagggcggguuugugcaccagcgcauggccuccaagaucgggcggugguacagccgcaccauguccaagacgaagcggaugggcaugggccuguacgucaaguacgacggggaucccuggaccgacagcgaggcgcuggcccucuccggcgugauggugagcauggaggagccggggugguacuccuucggcuuugagaucaaggacaagaagugcgacguccccugcaucgggaucgagauggugcacgauggcggcaagaccaccuggcacagcgccgccacggccaucuacugccugaugggguccggccagcugcucugggacaccgugaccggggucgacauggcgcuguga

SEQ ID NO: 30145 - RNA, 1401 nt, Artificial Sequence; identical to SEQ ID NO: 30144
  derived and/or modified CDS sequence (AUadapt) from InfluenzaB__AHL92369__NA

SEQ ID NO: 30146 - RNA, 1401 nt, Artificial Sequence
  derived and/or modified CDS sequence (AUadapt) from InfluenzaB__AHL92380__NA
augcugcccaguaccauccagacccucacgcuguuccugaccuccggcggggugcuccugagccuguacgucuccgccagccucuccuaccugcuguacagugacauccuccugaaguucucccgcaccgagaucaccgccccgaucaugccccuggacugcgcgaacgccagcaaugugcaggccgugaaccgguccgccacgaagggcgucaagcuccugcugcccgagcccgaguggaccuacccgcgccucagcugccccggguccaccuuccagaaggcccugcugaucucgccccaccgguuuggcgagaccaaggggaacuccgcgccccucaucauccgcgagccguucaucgccugcggccccaaggagugcaagcacuucgcccugacgcauuacgccgcgcagcccggcggguacuacaacggcacccgggaggaccgcaacaagcugcggcaccucaucagugugaagcuggggaagauccccaccguggagaacuccaucuuccacauggccgccuggagcggcuccgccugccacgaugggcgcgaguggaccuacaucggcgucgacggcccggacucgaacgcccugcucaagaucaaguacggggaggcguacacggauaccuaccacuccuacgccaagaacauccugcggacccaggagagcgccugcaauugcaucggcggggacugcuaccugaugaucaccgacggccccgccagcggcaucuccgagugucgcuuccucaagauccgggaggggcgcaucaucaaggagaucuuccccacgggccgggugaagcacaccgaggagugcacgugcggguucgccucgaauaagaccaucgagugcgcgugccgcgacaacuccuacaccgccaagcggcccuucgugaagcugaaugucgagaccgacaccgccgagauccgccugaugugcaccgagacguaccucgacaccccgcggcccaacgacggcagcaucaccgggcccugugaguccaacggcgacaagggcagcgggggcaucaagggcggguucgugcaccagcgcauggccuccaagaucgggcggugguacagucgcaccauguccaagacgaagcggaugggcaugggccuguacgugaaguacgacggggaccccuggaccgacagcgaggcccuggcgcucuccggcgucauggugagcauggaggagccggggugguauuccuucggcuucgagaucaaggacaagaagugcgacgugcccugcaucgggaucgagaugguccaugacggcggcaagaccaccuggcacagcgccgccacggccaucuacugccugaugggguccggccagcugcucugggacaccgugaccggggugaacaugacccuguga

SEQ ID NO: 30147 - RNA, 1401 nt, Artificial Sequence
  derived and/or modified CDS sequence (AUadapt) from InfluenzaB__AHL92391__NA
augcugcccaguaccauccagacccucacgcuguuccugaccuccggcggggugcuccugagccuguacgucuccgccagccucuccuaccugcuguauagcgacauccuccugaaguucucccgcaccgagaucaccgccccgaucaugccccuggacugcgcgaacgccaguaacgugcaggccgugaaccgguccgccacgaagggcgucacccuccugcugcccgagcccgaguggaccuacccgcgccucucgugccccggguccaccuuucagaaggcccugcugaucagcccccaccgguucggcgagacgaaggggaacuccgcgccccucaucauccgcgagccguucaucgccugcggccccaaggaguguaagcacuucgcccugacccacuacgccgcgcagcccggcggguacuacaauggcacccgggaggaccgcagcaagcugcggcaccucaucuccgugaagcuggggaagauccccaccguggagaacagcaucuuucacauggccgccugguccggcagcgccugccacgacgggcgcgaguggacguacaucggcgucgauggcccggacuccaacgcccugcucaagaucaaguacggggaggcguacaccgacaccuaucacucguacgccaagaacauccugcggacccaggagagcgccugcaauugcaucggcggggacugcuaccugaugaucacggacggccccgccuccggcaucagcgagugucgcuuccucaagauccgggaggggcgcaucaucaaggagaucuuccccaccggccgggugaagcacaccgaggagugcacgugcggguuugccuccaacaagaccaucgagugcgcgugccgcgacaacagcuauaccgccaagcggcccuucgugaagcugaacgucgagaccgacaccgccgagauccgccugaugugcacggagaccuaccucgauaccccgcggcccaacgacggcuccaucaccgggcccugcgagagcaacggcgacaagggcuccgggggcaucaagggcggguuugugcaccagcgcauggccucgaagaucgggcggugguacucccgcacgaugagcaagaccaagcggaugggcaugggccuguacgugaaguacgauggggaccccuggaccgacuccgaggcccuggcgcucagcggcgucaugguguccauggaggagccggggugguacagcuuuggcuucgagaucaaggacaagaagugcgacgugcccugcaucgggaucgagaugguccacgauggcggcaagaccacguggcacuccgccgccaccgccaucuacugccugauggggagcggccagcugcucugggacaccgugaccggggugaacaugacgcuguga

SEQ ID NO: 30148 - RNA, 1401 nt, Artificial Sequence; identical to SEQ ID NO: 28686
  derived and/or modified CDS sequence (AUadapt) from InfluenzaB__AHL92402__NA

SEQ ID NO: 30149 - RNA, 1401 nt, Artificial Sequence; identical to SEQ ID NO: 28686
  derived and/or modified CDS sequence (AUadapt) from InfluenzaB__AHL92413__NA

SEQ ID NO: 30150 - RNA, 1401 nt, Artificial Sequence; identical to SEQ ID NO: 28686
  derived and/or modified CDS sequence (AUadapt) from InfluenzaB__AHL92424__NA

SEQ ID NO: 30151 - RNA, 1401 nt, Artificial Sequence
  derived and/or modified CDS sequence (AUadapt) from InfluenzaB__AHL92435__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaacgccaguaacgugcaggccgugaaccgcuccgccgccaagggcgucacgcuccugcugcccgagcccgaguggaccuacccgcggcucagcugccccggguccaccuuucagaaggcgcugcugaucagcccccaccgcuucggcgagaccaaggggaacuccgcgccccucaucauccgggagccguucaucgccugcggccccacggaguguaagcacuucgcccugacccacuacgccgcccagcccggcggguacuacaauggcacccgcgaggaccggaacaagcugcgccaccucaucagcgugaagcuggggaagauccccaccguggagaacuccaucuuucacauggccgccuggagcggcuccgccugccacgacgggaaggaguggacguacaucggcgucgauggcccggacucgaacgcgcugcucaagaucaaguacggggaggccuacaccgauaccuaccacuccuacgccaagaacauccugcggacccaggagagcgccugcaauugcaucggcggggacugcuaccugaugaucacggacggccccgccagcggcaucuccgagugucgcuuccucaagauccgggaggggcgcaucaucaaggagaucuuccccaccggccgggugaagcacaccgaggagugcacgugcggguuugcgagcaacaagaccaucgagugcgccugccgcgacaacuccuauaccgccaagcggcccuucgugaagcugaacgucgagaccgacaccgccgagauccgccugaugugcacggagaccuaccucgauaccccgcggcccaacgacggcagcaucaccgggcccugcgaguccgacggcgacaagggcagugggggcaucaagggcggguucgugcaccagcgcauggccuccaagaucgggcggugguacagccgcacgauguccaagaccaagcggaugggcaugggccuguacgugaaguacgauggggaccccuggaccgacagcgaggcgcuggcccucuccggcgucaugaucagcauggaggagccggggugguacuccuuuggcuucgagaucaaggacaagaagugcgacgugcccugcaucgggaucgagauggugcacgauggcggcaagaccacguggcacagcgccgccaccgccaucuacugccugaugggguccggccagcugcucugggacaccgucaccgggguggacauggcgcuguga

SEQ ID NO: 30152 - RNA, 1401 nt, Artificial Sequence; identical to SEQ ID NO: 28686
  derived and/or modified CDS sequence (AUadapt) from InfluenzaB__AHL92446__NA

SEQ ID NO: 30153 - RNA, 1401 nt, Artificial Sequence; identical to SEQ ID NO: 28686
  derived and/or modified CDS sequence (AUadapt) from InfluenzaB__AHL92457__NA

SEQ ID NO: 30154 - RNA, 1401 nt, Artificial Sequence; identical to SEQ ID NO: 28686
  derived and/or modified CDS sequence (AUadapt) from InfluenzaB__AHL92468__NA

SEQ ID NO: 30155 - RNA, 1401 nt, Artificial Sequence; identical to SEQ ID NO: 28686
  derived and/or modified CDS sequence (AUadapt) from InfluenzaB__AHL92479__NA

SEQ ID NO: 30156 - RNA, 1401 nt, Artificial Sequence; identical to SEQ ID NO: 28901
  derived and/or modified CDS sequence (AUadapt) from InfluenzaB__AHL92490__NA

SEQ ID NO: 30157 - RNA, 1401 nt, Artificial Sequence; identical to SEQ ID NO: 28686
  derived and/or modified CDS sequence (AUadapt) from InfluenzaB__AHL92501__NA

SEQ ID NO: 30158 - RNA, 1401 nt, Artificial Sequence
  derived and/or modified CDS sequence (AUadapt) from InfluenzaB__AHL92512__NA
augcugcccaguaccauccagacccucacgcuguuccugaccuccggcggggugcuccugagccuguacgucuccgccagccucuccuaccugcuguacagugacauccuccugaaguucucccgcaccgagaucaccgccccgaucaugccccuggacugcgcgaacgccagcaaugugcaggccgugaaccgguccgccacgaagggcgucacccuccugcugcccgagcccgaguggaccuacccgcgccucagcugccccggguccaccuuccagaaggcccugcugaucagcccccaccgguuuggcgagacgaaggggaacuccgcgccccucaucauccgcgagccguucaucgccugcggccccaaggagugcaagcacuucgcccugacccauuacgccgcgcagcccggcggguacuacaacggcacccgggaggaccgcaacaagcugcggcaccucaucagugugaagcuggggaagauccccaccguggagaacuccaucuuccacauggucgccuggagcggcuccgccugccacgaugggcgcgaguggacguacaucggcguggacggcccggacagcaacgcccugcucaagaucaaguacggggaggccuacaccgauaccuaccacuccuacgcgaagaacauccugcggacccaggagagcgccugcaauugcaucggcggggacugcuaccugaugaucacggacggccccgccucgggcaucuccgagugucgcuuccucaagauccgggaggggcgcaucaucaaggagaucuuccccaccggccgggugaagcacaccgaggagugcacgugcggguucgccagcaauaagaccaucgagugcgccugccgcgacaacuccuacaccgcgaagcggcccuucgucaagcugaauguggagaccgacaccgccgagauccgccugaugugcacggagaccuaccucgacaccccgcggcccaacgacggcagcaucaccgggcccugugaguccaacggcgacaagggcagcgggggcaucaagggcggguucgugcaccagcgcauggccuccaagaucgggcggugguacagucgcacgauguccaagaccaagcggaugggcaugggccuguacgucaaguacgacggggaccccuggaccgacagcgaggcccuggcccucuccggcgugauggugagcauggaggagccggggugguauuccuucggcuucgagaucaaggacaagaagugcgacguccccugcaucgggaucgagauggugcaugacggcggcaagaccacguggcacagcgcggccaccgccaucuacugccugaugggguccggccagcugcucugggacaccgugaccggggucaacaugacgcuguga

SEQ ID NO: 30159 - RNA, 1401 nt, Artificial Sequence; identical to SEQ ID NO: 28686
  derived and/or modified CDS sequence (AUadapt) from InfluenzaB__AHL92523__NA

SEQ ID NO: 30160 - RNA, 1401 nt, Artificial Sequence; identical to SEQ ID NO: 28686
  derived and/or modified CDS sequence (AUadapt) from InfluenzaB__AHL92534__NA

SEQ ID NO: 30161 - RNA, 1401 nt, Artificial Sequence; identical to SEQ ID NO: 28901
  derived and/or modified CDS sequence (AUadapt) from InfluenzaB__AHL92545__NA

SEQ ID NO: 30162 - RNA, 1401 nt, Artificial Sequence; identical to SEQ ID NO: 28686
  derived and/or modified CDS sequence (AUadapt) from InfluenzaB__AHL92556__NA

SEQ ID NO: 30163 - RNA, 1401 nt, Artificial Sequence; identical to SEQ ID NO: 28686
  derived and/or modified CDS sequence (AUadapt) from InfluenzaB__AHL92567__NA

SEQ ID NO: 30164 - RNA, 1401 nt, Artificial Sequence; identical to SEQ ID NO: 28686
  derived and/or modified CDS sequence (AUadapt) from InfluenzaB__AHL92578__NA

SEQ ID NO: 30165 - RNA, 1401 nt, Artificial Sequence; identical to SEQ ID NO: 28901
  derived and/or modified CDS sequence (AUadapt) from InfluenzaB__AHL92589__NA

SEQ ID NO: 30166 - RNA, 1401 nt, Artificial Sequence; identical to SEQ ID NO: 28686
  derived and/or modified CDS sequence (AUadapt) from InfluenzaB__AHL92600__NA

SEQ ID NO: 30167 - RNA, 1401 nt, Artificial Sequence; identical to SEQ ID NO: 29957
  derived and/or modified CDS sequence (AUadapt) from InfluenzaB__AHL92611__NA

SEQ ID NO: 30168 - RNA, 1401 nt, Artificial Sequence
  derived and/or modified CDS sequence (AUadapt) from InfluenzaB__AHL92622__NA
augcugcccaguaccauccagacccucacgcuguuccugaccuccggcggggugcuccugagccuguacgucuccgccagccucuccuaccugcuguacagugacauccuccugaaguucucccgcaccgagaucaccgccccgaucaugccccuggacugcgcgaacgccagcaacgugcaggccgugaaucgguccgccacgaagggcgucaccuuccuccugcccgagcccgaguggaccuacccgcgccugagcugccccggguccaccuuccagaaggcccuccugaucagcccccaucgguucggcgagacgaaggggaacuccgcgccccugaucauccgcgagccguucaucgccugcggccccaaggagugcaagcacuucgcccucacccauuacgccgcgcagcccggcggguacuacaacggcacccgggaggaccgcaacaagcugcggcaucugaucucggugaagcucgggaagauccccaccguggagaacuccaucuuccacauggccgccuggagcggcuccgccugccacgaugggcgcgaguggacguacaucggcgucgacggcccggacagcaacgcccugcugaagaucaaguacggggaggcguauaccgacaccuaccacuccuacgccaagaacauccuccggacccaggagagcgccugcaauugcaucggcggggacugcuaccugaugaucacggacggccccgccucgggcaucuccgagugucgcuuccugaagauccgggaggggcgcaucaucaaggagaucuuccccaccggccgggugaagcacaccgaggagugcacgugcggguucgccagcaauaagaccaucgagugcgcgugccgcgacaacuccuacaccgccaagcggcccuucgugaagcucaaugucgagaccgacaccgccgagauccgccugaugugcacggagaccuaccuggacaccccgcggcccaacgacggcagcaucaccgggcccugugaguccaacggcgacaagggcagcgggggcaucaagggcggguucgugcaccagcgcauggccuccaagaucgggcggugguacagucgcacgauguccaagaccaagcggaugggcaugggccucuacgugaaguacgacggggaccccuggaccgacagcgaggcccuggcgcuguccggcgucauggugagcauggaggagccggggugguauuccuucggcuucgagaucaaggacaagaagugcgacgugcccugcaucgggaucgagaugguccaugacggcggcaagaccacguggcacagcgccgccaccgccaucuacugccucaugggguccggccagcugcugugggacaccgugaccggggugaacaugacgcucuga

SEQ ID NO: 30169 - RNA, 1401 nt, Artificial Sequence
  derived and/or modified CDS sequence (AUadapt) from InfluenzaB__AHL92633__NA
augcugcccaguaccauccagacccucacgcuguuccugaccuccggcggggugcuccugagccuguacgucuccgccagccucuccuaccugcuguacucggauauccuccugaaguucucccgcaccgagaucaccgccccgaucaugccccuggacugcgcgaacgccagcaacgugcaggccgugaaccgguccgccacgaagggcgucaccuuucuccugcccgagcccgaguggaccuacccgcgccugagcugccccggguccaccuuccagaaggcccuccugaucagcccccaccgguucggcgagacgaaggggaauuccgcgccccugaucauccgcgagccguucaucgccugcggccccaaggagugcaagcacuucgcccucacccacuacgccgcgcagcccggcggguauuacaacggcacccgggaggaccgcaacaagcugcggcaccugaucucggugaagcucgggaagauccccaucguggagaacuccaucuuucacauggccgccuggagcggcuccgccugccacgacgggcgcgaguggaccuacaucggcgucgacggcccggauagcaacgcccugcugaagaucaaguacggggaggcguacacggacaccuaccacuccuaugccaagaacauccuccggacccaggagagcgccugcaacugcaucggcggggacugcuaucugaugaucaccgacggccccgccucgggcaucuccgagugccgcuuccugaagauccgggaggggcgcaucaucaaggagaucuuccccacgggccgggugaagcacaccgaggagugcacguguggguucgccagcaacaagaccaucgagugcgcgugccgcgacaacuccuauaccgccaagcggcccuucgugaagcucaacgucgagaccgacaccgccgagauccgccugaugugcaccgagacguaccuggacaccccgcggcccaacgauggcagcaucaccgggcccugcgaguccaacggcgacaagggcagcgggggcaucaagggcggguucgugcaccagcgcauggccuccaagaucgggcggugguauucgcgcaccauguccaagacgaagcggaugggcaugggccucuacgugaaguacgacggggaccccuggaccgacagcgaggcccuggcgcuguccggcgucauggugaguauggaggagccggggugguacuccuucggcuucgagaucaaggacaagaagugcgacgugcccugcaucgggaucgagaugguccaugacggcggcaagaccaccuggcacagcgccgccacggccaucuacugccucaugggguccggccagcugcugugggacaccgugaccggggugaacaugacccucuga

SEQ ID NO: 30170 - RNA, 1401 nt, Artificial Sequence; identical to SEQ ID NO: 28901
  derived and/or modified CDS sequence (AUadapt) from InfluenzaB__AHL92644__NA

SEQ ID NO: 30171 - RNA, 1401 nt, Artificial Sequence; identical to SEQ ID NO: 28901
  derived and/or modified CDS sequence (AUadapt) from InfluenzaB__AHL92655__NA

SEQ ID NO: 30172 - RNA, 1401 nt, Artificial Sequence; identical to SEQ ID NO: 28686
  derived and/or modified CDS sequence (AUadapt) from InfluenzaB__AHL92666__NA

SEQ ID NO: 30173 - RNA, 1401 nt, Artificial Sequence; identical to SEQ ID NO: 28686
  derived and/or modified CDS sequence (AUadapt) from InfluenzaB__AHL92677__NA

SEQ ID NO: 30174 - RNA, 1401 nt, Artificial Sequence; identical to SEQ ID NO: 28901
  derived and/or modified CDS sequence (AUadapt) from InfluenzaB__AHL92688__NA

SEQ ID NO: 30175 - RNA, 1401 nt, Artificial Sequence; identical to SEQ ID NO: 28686
  derived and/or modified CDS sequence (AUadapt) from InfluenzaB__AHL92699__NA

SEQ ID NO: 30176 - RNA, 1401 nt, Artificial Sequence; identical to SEQ ID NO: 28686
  derived and/or modified CDS sequence (AUadapt) from InfluenzaB__AHL92710__NA

SEQ ID NO: 30177 - RNA, 1401 nt, Artificial Sequence; identical to SEQ ID NO: 28686
  derived and/or modified CDS sequence (AUadapt) from InfluenzaB__AHL92721__NA

SEQ ID NO: 30178 - RNA, 1401 nt, Artificial Sequence; identical to SEQ ID NO: 28686
  derived and/or modified CDS sequence (AUadapt) from InfluenzaB__AHL92732__NA

SEQ ID NO: 30179 - RNA, 1401 nt, Artificial Sequence; identical to SEQ ID NO: 28686
  derived and/or modified CDS sequence (AUadapt) from InfluenzaB__AHL92743__NA

SEQ ID NO: 30180 - RNA, 1401 nt, Artificial Sequence; identical to SEQ ID NO: 28686
  derived and/or modified CDS sequence (AUadapt) from InfluenzaB__AHL92754__NA

SEQ ID NO: 30181 - RNA, 1401 nt, Artificial Sequence; identical to SEQ ID NO: 28686
  derived and/or modified CDS sequence (AUadapt) from InfluenzaB__AHL92765__NA

SEQ ID NO: 30182 - RNA, 1401 nt, Artificial Sequence; identical to SEQ ID NO: 28686
  derived and/or modified CDS sequence (AUadapt) from InfluenzaB__AHL92776__NA

SEQ ID NO: 30183 - RNA, 1401 nt, Artificial Sequence; identical to SEQ ID NO: 28686
  derived and/or modified CDS sequence (AUadapt) from InfluenzaB__AHL92787__NA

SEQ ID NO: 30184 - RNA, 1401 nt, Artificial Sequence; identical to SEQ ID NO: 28686
  derived and/or modified CDS sequence (AUadapt) from InfluenzaB__AHL92798__NA

SEQ ID NO: 30185 - RNA, 1401 nt, Artificial Sequence
  derived and/or modified CDS sequence (AUadapt) from InfluenzaB__AHL92809__NA
augcugcccaguaccauccagacccucacgcuguuccugaccuccggcggggugcuccugagccuguacgucuccgccagccucuccuaccugcuguacagugacauccuccugaaguucucccgcaccgagaucaccgccccgaucaugccccuggacugcgcgaacgccagcaaugugcaggccgugaaccgguccgccaucaagggcgucacgcuccugcugcccgagcccgaguggaccuacccgcgccucagcugccccggguccaccuuccagaaggcccugcugaucagcccccaccgguuuggcgagaccaaggggaacuccgcgccccucaucauccgcgagccguucaucgccugcggccccaaggagugcaagcacuucgcccugacgcauuacgccgcgcagcccggcggguacuacaacggcacccgggaggaccgcaacaagcugcggcaccucaucagugugaagcuggggaagauccccaccguggagaacuccaucuuccacauggccgccuggagcggcuccgccugccacgaugggcgcgaguggaccuacaucggcgucgacggcccggacagcaacgcccugcucaagaucaaguacggggaggcguacacggauaccuaccacuccuacgccaagaacauccugcggacccaggagagcgccugcaauugcaucggcggggacugcuaccugaugaucaccgacggccccgccucgggcaucuccgagugucgcuuccucaagauccgggaggggcgcaucaucaaggagaucuuccccacgggccgggugaagcacaccgaggagugcacgugcggguucgccagcaauaagaccaucgagugcgcgugccgcgacaacuccuacaccgccaagcggcccuucgugaagcugaaugucgagaccgacaccgccgagauccgccugaugugcaccgagacguaccucgacaccccgcggcccaacgacggcagcaucaccgggcccugugaguccaacggcgacaagggcagcgggggcaucaagggcggguucgugcaccagcgcauggccuccaagaucgggcggugguacagucgcaccauguccaagacgaagcggaugggcaugggccuguacgugaaguacgacggggaccccuggaccgacagcgaggcccuggcgcucuccggcgucauggugagcauggaggagccggggugguauuccuucggcuucgagaucaaggacaagaagugcgacgugcccugcaucgggaucgagaugguccaugacggcggcaagaccaccuggcacagcgccgccacggccaucuacugccugaugggguccggccagcugcucugggacaccgugaccggggugaacaugacccuguga

SEQ ID NO: 30186 - RNA, 1401 nt, Artificial Sequence
  derived and/or modified CDS sequence (AUadapt) from InfluenzaB__AHL92820__NA
augcugcccaguaccauccagacccucacgcuguuccugaccuccggcggggugcuccugagccuguacgucuccgccagccucuccuaccugcuguacagugacauccuccugaaguucucccgcaccgagaucaccgccccgaucaugccccuggacugcgcgaacgccagcaaugugcaggccgugaaccgguccgccacgaagggcgucacccuccugcugcccgagcccgaguggaccuacccgcgccucagcugccccggguccaccuuccagaaggcccugcugaucucgccccaccgguuuggcgagacgaaggggaacuccgcgccccucaucauccgcgagccguucaucgccugcggccccaaggagugcaagcacuucgcccugacccauuacgccgcgcagcccggcggguacuacaacggcacccgggaggaccgcaacaagcugcggcaccucaucagugugaagcuggggaagauccccaccguggagaacuccaucuuccacauggccgccuggagcggcuccgccugccacgaugggcgcgaguggacguacaucggcgucgacggcccggacucgaacgcccugcucaagaucaaguacggggaggcguacaccgauaccuaccacuccuacgccaagaacauccugcggacccaggagagcgccugcaauugcaucggcggggacugcuaccugaugaucacggacggccccgccagcggcaucuccgagugucgcuuccucaagauccgggaggggcgcaucaucaaggagaucuuccccaccggccgggugaagcacaccgaggagugcacgugcggguucgccucgaauaagaccaucgagugcgcgugccgcgacaacuccuacaccgccaagcggcccuucgugaagcugaaugucgagaccgacaccgccgagauccgccugaugugcacggagaccuaccucgacaccccgcggcccaacgacggcagcaucaccgggcccugugaguccaacggcgacaagggcagcgggggcaucaagggcggguucgugcaccagcgcauggccuccaagaucgggcggugguacagucgcacgauguccaagaccaagcggaugggcaugggccuguacgugaaguacgacggggaccccuggaccgacagcgaggcccuggcgcucuccggcgucauggugagcauggaggagccggggugguauuccuucggcuucgagaucaaggacaagaagugcgacgugcccugcaucgggaucgagaugguccaugacggcggcaagaagaccuggcacagcgccgccacggccaucuacugccugaugggguccggccagcugcucugggacaccgugaccggggugaacaugacccuguga

SEQ ID NO: 30187 - RNA, 1401 nt, Artificial Sequence
  derived and/or modified CDS sequence (AUadapt) from InfluenzaB__AHL92842__NA
augcugcccaguaccauccagacccucacgcuguuccugaccuccggcggggugcuccugagccuguacgucuccgccagccucuccuaccugcuguacagugacauccuccugaaguucucccgcaccgagaucaccgccccgaucaugccccuggacugcgcgaacgccagcaaugugcaggccgugaaccgguccacgaccaagggcgucacccuccugcugcccgagcccgaguggaccuacccgcgccucagcugccccggguccacguuccagaaggcccugcugaucucgccccaccgguuuggcgagaccaaggggaacuccgcgccccucaucauccgcgagccguucaucgccugcggccccaaggagugcaagcacuucgcccugacccauuacgccgcccagcccggcggguacuacaacggcacccgggaggaccgcaacaagcugcggcaccucaucagugugaagcuggggaagauccccacgguggagaacuccaucuuccacauggcggccuggagcggcuccgccugccacgaugggcgcgaguggaccuacaucggcgucgacggcccggacucgaacgcccugcucaagaucaaguacggggaggccuacaccgauaccuaccacuccuacgcgaagaacauccugcggacgcaggagagcgccugcaauugcaucggcggggacugcuaccugaugaucaccgacggccccgccagcggcaucuccgagugucgcuuccucaagauccgggaggggcgcaucaucaaggagaucuuccccaccggccgggugaagcacaccgaggagugcacgugcggguucgccucgaauaagaccaucgagugcgccugccgcgacaacuccuacaccgcgaagcggcccuucgugaagcugaaugucgagaccgacacggccgagauccgccugaugugcaccgagaccuaccucgacaccccgcggcccaacgacggcagcaucacggggcccugugaguccaacggcgacaagggcagcgggggcaucaagggcggguucgugcaccagcgcauggccuccaagaucgggcggugguacagucgcaccauguccaagaccaagcggaugggcaugggccuguacgugaaguacgacggggaccccuggaccgacagcgaggcccuggcccucuccggcgucauggugagcauggaggagccggggugguauuccuucggcuucgagaucaaggacaagaagugcgacgugcccugcaucgggaucgagaugguccaugacggcggcaagacgaccuggcacagcgcggccaccgccaucuacugccugaugggguccggccagcugcucugggacaccgugacgggggugaacaugacccuguga

SEQ ID NO: 30188 - RNA, 1401 nt, Artificial Sequence; identical to SEQ ID NO: 28686
  derived and/or modified CDS sequence (AUadapt) from InfluenzaB__AHL92853__NA

SEQ ID NO: 30189 - RNA, 1401 nt, Artificial Sequence; identical to SEQ ID NO: 28686
  derived and/or modified CDS sequence (AUadapt) from InfluenzaB__AHL92864__NA

SEQ ID NO: 30190 - RNA, 1401 nt, Artificial Sequence; identical to SEQ ID NO: 28783
  derived and/or modified CDS sequence (AUadapt) from InfluenzaB__AHL92875__NA

SEQ ID NO: 30191 - RNA, 1401 nt, Artificial Sequence; identical to SEQ ID NO: 28740
  derived and/or modified CDS sequence (AUadapt) from InfluenzaB__AHL92886__NA

SEQ ID NO: 30192 - RNA, 1401 nt, Artificial Sequence
  derived and/or modified CDS sequence (AUadapt) from InfluenzaB__AHL92897__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaucccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaacgaguguaagcacuucgcccugacccacuacgccgcgcagcccggcggguacuacaauggcacccgcggggaccggaacaagcugcgccaccucaucagcgugaagcugggcaagaucccgacgguggagaacuccaucuuccauauggccgccuggagcggguccgccugccacgacggcaaggaguggaccuacaucggcgucgacgggcccgauaacaacgcccugcucaagaucaaguacggcgaggcguacaccgacaccuaccauucguacgccaacaacauccugcggacgcaggaguccgccugcaacuguaucgggggcaacugcuaccugaugaucaccgacggcagcgccagcgggguguccgagugucgcuuccucaagauccgggagggccgcaucaucaaggagaucuuccccaccgggcgggugaagcacaccgaggagugcacgugcggcuucgccaguaacaagaccaucgagugcgcgugccgcgacaacuccuacaccgccaagcggcccuuugucaagcugaacguggagaccgacacggccgagauccgccugaugugcaccgacaccuaccucgacaccccgcggcccgaugacgggagcaucacgggccccugcgaguccaacggcgacaaggggucgggcgggaucaagggcggguuugugcaccagcgcauggccuccaagaucggccggugguacagccgcaccauguccaagaccgagcggaugggcauggggcuguacgucaaguacgacggcgaucccugggccgacagcgacgcgcuggccuucuccggggugauggugagcaugaaggagccgggcugguacuccuuuggguucgagaucaaggacaagaagugcgacguccccugcaucggcaucgagauggugcacgauggcgggaaggagaccuggcacagcgccgccacggccaucuacugccucaugggcuccgggcagcugcugugggacaccgugaccggcgucgacauggcgcucuga

SEQ ID NO: 30193 - RNA, 1401 nt, Artificial Sequence
  derived and/or modified CDS sequence (AUadapt) from InfluenzaB__AHL92908__NA
augcugcccaguaccauccagacccucacgcuguuccugacccucggcggggugcugcugucccucuacgucagcgccucccugagcuaccugcucuacuccgauauccugcugaaguucucgcagaccgagaucaccgccccgaucaugccccucgacugcgcgaacgccuccaacgugcaggccgugaaucgcagcgccacgaagggcgucacccugcugcuccccgagcccgaguggaccuacccgcggcuguccugccccgggagcaccuuccagaaggcccugcucaucucgccccaccgcuuuggcgagacgaaggggaacuccgcgccccugaucauccgggagccguucaucgccugcggccccaaggagugcaagcacuucgcccugacccauuacgccgcgcagcccggcggguacuacaacggcacccgcgaggaccggaacaagcuccgccaccugaucuccgugaagcuggggaagauccccaccguggagaauagcaucuuccacauggccgccugguccggcagcgccugccacgaugggaaggaguggacguacaucggcgucgacggcccggacuccaacgcccuccugaagaucaaguacggggaggcguacaccgacaccuaucacucguacgccaagaacauccugcggacccaggaguccgccugcaacuguaucggcggggacugcuaccucaugaucacggacggccccgccagcggcaucagcgagugucgcuuccugaagauccgggaggggcgcaucaucaaggagaucuuccccaccggccgggugaagcacaccgaggagugcacgugcggguucgccuccaacaagaccaucgagugugcgugccgcgacaacucguacaccgccaagcggcccuucgugaagcugaaugucgagaccgacaccgccgagauccgccucaugugcacggagaccuaccuggacaccccgcggcccaacgacggcuccaucaccgggcccugcgagaguaacggcgacaagggcuccgggggcaucaagggcggguucgugcaccagcgcauggccagcaagaucgggcggugguacucccgcacgaugaguaagaccaagcggaugggcaugggccuguacgugaaguacgacggggaccccuggaccgacuccgaggcccucgcgcugagcggcgucaugguguccauggaggagccggggugguacaguuucggcuucgagaucaaggacaagaagugcgacgugcccugcaucgggaucgagaugguccaugacggcggcaagaccacguggcacuccgccgccaccgccguguacugccugauggggagcggccagcuccugugggacaccaucaccgggguggacauggcccuguga

SEQ ID NO: 30194 - RNA, 1401 nt, Artificial Sequence
  derived and/or modified CDS sequence (AUadapt) from InfluenzaB__AHL92919__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccgcuccgccaccaagggcgucacccuccugcugcccgagccggaguggaccuacccccggcucagcugccccggguccacguuccagaaggcccugcugaucagcccccaccgcuuuggcgagaccaaggggaacuccgcgccgcucaucauccgggagcccuucaucgccugcggccccaacgagugcaagcacuuugcccugacccacuacgccgcgcagcccggcggguacuacaacggcacccgcggggaccggaauaagcugcgccaccucaucucggugaagcugggcaagaucccgacgguggagaacuccaucuuccacauggccgccuggagcggguccgccugccaugacggcaaggaguggaccuacaucggcaucgacgggcccgacaacaacgcccugcucaagaucaaguauggcgaggcguacaccgacaccuaccacagcuacgccaauaacauccugcggacgcaggaguccgccugcaacugcaucgggggcaacugcuaccugaugaucaccgauggcagcgccucgggggucuccgagugccgcuuccucaagauccgggagggccgcaucaucaaggagaucuuccccaccgggcgggugaagcacaccgaggaguguacgugcggcuucgccagcaacaagaccaucgagugcgcgugccgcgauaacuccuacaccgccaagcggcccuucgugaagcugaacgucgagaccgacacggccgagauccgccugaugugcaccgacaccuaucucgacaccccgcggcccgacgacgggagcaucacgggccccugcgaguccaacggcgauaaggggagcggcgggaucaagggcggguucgugcaccagcgcauggccuccaagaucggccggugguacucgcgcaccauguccaagaccgagcggaugggcauggggcuguacgugaaguaugacggcgaccccugggccgacagcgacgcgcuggccuucuccggggucauggugagcaugaaggagccgggcugguauuccuucggguucgagaucaaggacaagaagugcgacgugcccugcaucggcaucgagaugguccaugacggcgggaaggagaccuggcacagcgccgccacggccaucuacugccucaugggcuccgggcagcugcugugggacaccgugaccggcguggacauggcgcucuga

SEQ ID NO: 30195 - RNA, 1401 nt, Artificial Sequence
  derived and/or modified CDS sequence (AUadapt) from InfluenzaB__AHL92930__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccagcaacgugcaggccgugaaccgcuccgccaccaagggcgucacccuccugcugcccgagccggaguggaccuacccccggcucagcugucccggguccacguuccagaaggcccugcugaucagcccccaccgcuucggcgagaccaaggggaacuccgcgccgcucaucauccgggagcccuucaucgccuguggccccaacgagugcaagcacuucgcccugacccacuaugccgcgcagcccggcggguacuacaacggcacccgcggggaccggaacaagcugcgccaucucaucagcgugaagcugggcaagaucccgacgguggagaacuccaucuuccacauggccgccuggagcggguccgccugucacgacggcaaggaguggaccuacaucggcgucgacgggcccgacaacgaugcccugcucaagaucaaguacggcgaggcguacaccgacaccuaccacaguuacgccaacaacauccugcggacgcaggaguccgccugcaacuguaucgggggcaacugcuaccugaugaucaccgacggcagcgccagugggguguccgagugccgcuuccucaagauccgggagggccgcaucaucaaggagaucuuccccaccgggcgggugaagcacaccgaggagugcacgugcggcuuugccagcaacaagaccaucgagugcgcgugccgcgacaauuccuacaccgccaagcggcccuucgucaagcuggacguggagaccgacacggccgagauccgccugaugugcaccgauaccuaccucgacaccccgcggcccgacgacgggagcaucacgggccccugugaguccaacggcgacaaggggagcggcgggaucaagggcggguucgugcaccagcgcauggccuccaagaucggccggugguacagucgcaccauguccaagaccgagcggaugggcauggggcuguacgucaaguacgacggcgaccccugggccgacagugacgcgcuggccuucuccggggugauggugagcaugaaggagccgggcugguacuccuucggguuugagaucaaggacaagaagugcgacguccccugcaucggcaucgagauggugcacgauggcgggaaggagaccuggcacagcgccgccacggccaucuacugccucaugggcuccgggcagcugcugugggacaccgugaccggcgucgacauggcgcucuga

SEQ ID NO: 30196 - RNA, 1401 nt, Artificial Sequence; identical to SEQ ID NO: 28740
  derived and/or modified CDS sequence (AUadapt) from InfluenzaB__AHL92941__NA

SEQ ID NO: 30197 - RNA, 1401 nt, Artificial Sequence; identical to SEQ ID NO: 28748
  derived and/or modified CDS sequence (AUadapt) from InfluenzaB__AHL92952__NA

SEQ ID NO: 30198 - RNA, 1401 nt, Artificial Sequence; identical to SEQ ID NO: 28748
  derived and/or modified CDS sequence (AUadapt) from InfluenzaB__AHL92963__NA

SEQ ID NO: 30199 - RNA, 1401 nt, Artificial Sequence
  derived and/or modified CDS sequence (AUadapt) from InfluenzaB__AHL92974__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcacgccgugaaccgcuccgccaccaagggcgucacccuccugcugcccgagccggaguggaccuacccccggcucagcugccccggguccacguuccagaaggcccugcugaucagcccccaucgcuucggcgagaccaaggggaacuccgcgccgcucaucauccgggagcccuucaucgccugcggccccaacgagugcaagcauuucgcccugacccacuacgccgcgcagcccggcggguacuacaacggcacccgcggggaccggaauaagcugcgccaccucaucucggugaagcugggcaagaucccgacgguggagaacuccaucuuccacauggccgccuggagcggguccgccugucacgacggcaaggaguggaccuacaucggcgucgacgggcccgacaacaaugcccugcucaagaucaaguacggcgaggcguacaccgacaccuaccacagcuacgccaauaacauccugcggacgcaggaguccgccugcaacugcaucgggggcaacugcuaucugaugaucaccgacggcagcgccucggggguguccgagugccgcuuccucaagauccgggagggccgcaucaucaaggagaucuuccccaccgggcgggugaagcacaccgaggaguguacgugcggcuucgccagcaacaagaccaucgagugcgcgugccgcgauaacuccuacaccgccaagcggcccuucgucaagcugaacguggagaccgacacggccgagauccgccugaugugcaccgauaccuaccucgacaccccgcggcccgacgacgggagcaucacgggccccugcgaguccaacggcgauaaggggagcggcgggaucaagggcggguucgugcaccagcgcauggccuccaagaucggccggugguacucgcgcaccauguccaagaccgagcggaugggcauggggcuguacgucaaguauaacggcgaccccugggccgacagcgacgcgcuggccuucuccggggugauggugagcaugaaggagccgggcugguauuccuucggguucgagaucaaggacaagaagugcgacguccccugcaucggcaucgagauggugcaugacggcgggaaggagaccuggcacagcgccgccacggccaucuacugccucaugggcuccgggcagcugcugugggacaccgugaccggcgucgacauggcgcucuga

SEQ ID NO: 30200 - RNA, 1401 nt, Artificial Sequence; identical to SEQ ID NO: 28748
  derived and/or modified CDS sequence (AUadapt) from InfluenzaB__AHL92985__NA

SEQ ID NO: 30201 - RNA, 1401 nt, Artificial Sequence; identical to SEQ ID NO: 28748
  derived and/or modified CDS sequence (AUadapt) from InfluenzaB__AHL92996__NA

SEQ ID NO: 30202 - RNA, 1401 nt, Artificial Sequence; identical to SEQ ID NO: 30121
  derived and/or modified CDS sequence (AUadapt) from InfluenzaB__AHL93008__NA

SEQ ID NO: 30203 - RNA, 1401 nt, Artificial Sequence; identical to SEQ ID NO: 30130
  derived and/or modified CDS sequence (AUadapt) from InfluenzaB__AHL93019__NA

SEQ ID NO: 30204 - RNA, 1401 nt, Artificial Sequence; identical to SEQ ID NO: 30130
  derived and/or modified CDS sequence (AUadapt) from InfluenzaB__AHL93030__NA

SEQ ID NO: 30205 - RNA, 1401 nt, Artificial Sequence; identical to SEQ ID NO: 30144
  derived and/or modified CDS sequence (AUadapt) from InfluenzaB__AHL93041__NA

SEQ ID NO: 30206 - RNA, 1401 nt, Artificial Sequence; identical to SEQ ID NO: 30144
  derived and/or modified CDS sequence (AUadapt) from InfluenzaB__AHL93052__NA

SEQ ID NO: 30207 - RNA, 1401 nt, Artificial Sequence; identical to SEQ ID NO: 28686
  derived and/or modified CDS sequence (AUadapt) from InfluenzaB__AHL93063__NA

SEQ ID NO: 30208 - RNA, 1401 nt, Artificial Sequence; identical to SEQ ID NO: 28686
  derived and/or modified CDS sequence (AUadapt) from InfluenzaB__AHL93074__NA

SEQ ID NO: 30209 - RNA, 1401 nt, Artificial Sequence; identical to SEQ ID NO: 28686
  derived and/or modified CDS sequence (AUadapt) from InfluenzaB__AHL93085__NA

SEQ ID NO: 30210 - RNA, 1401 nt, Artificial Sequence; identical to SEQ ID NO: 30187
  derived and/or modified CDS sequence (AUadapt) from InfluenzaB__AHL93096__NA

SEQ ID NO: 30211 - RNA, 1401 nt, Artificial Sequence; identical to SEQ ID NO: 28686
  derived and/or modified CDS sequence (AUadapt) from InfluenzaB__AHL93107__NA

SEQ ID NO: 30212 - RNA, 1401 nt, Artificial Sequence; identical to SEQ ID NO: 28686
  derived and/or modified CDS sequence (AUadapt) from InfluenzaB__AHL93118__NA

SEQ ID NO: 30213 - RNA, 1401 nt, Artificial Sequence; identical to SEQ ID NO: 28901
  derived and/or modified CDS sequence (AUadapt) from InfluenzaB__AHL93129__NA

SEQ ID NO: 30214 - RNA, 1401 nt, Artificial Sequence; identical to SEQ ID NO: 28686
  derived and/or modified CDS sequence (AUadapt) from InfluenzaB__AHL93140__NA

SEQ ID NO: 30215 - RNA, 1401 nt, Artificial Sequence; identical to SEQ ID NO: 28901
  derived and/or modified CDS sequence (AUadapt) from InfluenzaB__AHL93151__NA

SEQ ID NO: 30216 - RNA, 1401 nt, Artificial Sequence; identical to SEQ ID NO: 28686
  derived and/or modified CDS sequence (AUadapt) from InfluenzaB__AHL93162__NA

SEQ ID NO: 30217 - RNA, 1401 nt, Artificial Sequence; identical to SEQ ID NO: 28686
  derived and/or modified CDS sequence (AUadapt) from InfluenzaB__AHL93173__NA

SEQ ID NO: 30218 - RNA, 1401 nt, Artificial Sequence; identical to SEQ ID NO: 28901
  derived and/or modified CDS sequence (AUadapt) from InfluenzaB__AHL93184__NA

SEQ ID NO: 30219 - RNA, 1401 nt, Artificial Sequence; identical to SEQ ID NO: 28686
  derived and/or modified CDS sequence (AUadapt) from InfluenzaB__AHL93195__NA

SEQ ID NO: 30220 - RNA, 1401 nt, Artificial Sequence; identical to SEQ ID NO: 28686
  derived and/or modified CDS sequence (AUadapt) from InfluenzaB__AHL93206__NA

SEQ ID NO: 30221 - RNA, 1401 nt, Artificial Sequence; identical to SEQ ID NO: 28640
  derived and/or modified CDS sequence (AUadapt) from InfluenzaB__AHL93217__NA

SEQ ID NO: 30222 - RNA, 1401 nt, Artificial Sequence; identical to SEQ ID NO: 28640
  derived and/or modified CDS sequence (AUadapt) from InfluenzaB__AHL93228__NA

SEQ ID NO: 30223 - RNA, 1401 nt, Artificial Sequence
  derived and/or modified CDS sequence (AUadapt) from InfluenzaB__AHL93239__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccucgaaugugcaggccgugaaccgcuccgccaccaagggcgucaccuuccuccugcccgagccggaguggaccuacccccggcugagcugccccggguccacguuccagaaggcccuccugaucagcccccaucgcuucggcgagaccaaggggaacuccgcgccgcugaucauccgggagcccuucaucgccugcggccccaacgagugcaagcauuucgcccucacccacuacgccgcgcagcccggcggguacuacaacggcacccgcggggaucggaacaagcugcgccaccugaucagcgugaagcucggcaagaucccgacgguggagaacuccaucuuccacauggccgccuggagcggguccgccugucacgacggcaaggaguggaccuacaucggcgucgacgggcccgacaacaaugcccugcugaaggugaaguacggcgaggcguacaccgacaccuaccacucguaugccaacaagauccuccggacgcaggaguccgccugcaacugcaucgggggcaacugcuaccugaugaucaccgauggcagcgccagcgggguguccgagugccgcuuccugaagauccgggagggccgcaucaucaaggagaucuuccccaccgggcgggucaagcacaccgaggaguguacgugcggcuucgccagcaacaagaccaucgagugcgcgugccgcgauaacuccuacaccgccaagcggcccuucgugaagcucaacguggagaccgacacggccgagauccgccugaugugcaccgacaccuaucuggacaccccgcggcccgacgacgggagcaucacgggccccugcgaguccaacggcgauaaggggucgggcgggaucaagggcggguucguccaccagcgcauggaguccaagaucggccggugguacagccgcaccauguccaagaccgagcggaugggcauggggcucuacgugaaguaugacggcgaccccugggccgacagcgacgcccuggcguucuccggggugauggucagcaugaaggagccgggcugguauuccuucggguucgagaucaaggacaagaagugcgacgugcccugcaucggcaucgagauggugcaugacggcgggaaggagaccuggcacagcgccgccacggccaucuacugccugaugggcuccgggcagcuccugugggacaccgucaccggcguggacauggcccuguga

SEQ ID NO: 30224 - RNA, 1401 nt, Artificial Sequence
  derived and/or modified CDS sequence (AUadapt) from InfluenzaB__AHL93250__NA
augcugcccaguaccauccagaugcucacccuguuccugacguccggcggggugcuccugagccuguacgucuccgccagccucuccuaccugcuguacagugacauccuccugaaguucuccccgaccgagaucaccgcccccaccaugccccuggacugcgcgaacgccagcaacgugcaugccgugaaccgcuccgccacgaagggcgucaccuuccuccugcccgagccggaguggaccuacccccggcugagcugccccggguccaccuuccagaaggcccuccugaucagcccccaucgcuucggcgagacgaaggggaacuccgcgccgcugaucauccgggagcccuucaucgccugcggccccaacgagugcaagcacuuugcccucacccacuacgccgcgcagcccggcggguacuacaacggcacccgcggggaccggaacaagcugcgccaucugaucucggugaagcucggcaagaucccgaccguggagaacuccaucuuccacauggccgccuggagcggguccgccugccacgauggcaaggaguggacguacaucggcgucgacgggcccgacaacaacgcccugcugaagaucaaguacggcgaggcguacaccgauaccuaccacagcuacgccaacaacauccuccggacccaggaguccgccugcaauugcaucgggggcaacugcuaccugaugaucacggacggcagcgccucggggguguccgagugucgcuuccugaagauccgggagggccgcaucaucaaggagaucuuccccaccgggcgggugaagcacaccgaggagugcacgugcggcuucgccagcaauaagaccaucgagugcgcgugccgcgacaacuccuacaccgccaagcggcccuucgucaagcucaacguggagaccgauaccgccgagauccgccugaugugcacggacaccuaccuggacaccccgcggcccgacgacgggagcaucaccggccccugugaguccaacggcgacaaggggagcggcgggaucaagggcggguucgugcaccagcgcauggccuccaagaucggccggugguacucgcgcacgauguccaagaccgagcggaugggcauggggcucuaugucaaguacgacggcgaccccuggaccgacagcgacgcccuggcguuccgcggggugaugguguccaugaaggagccgggcugguauagcuucggguucgagaucaaggacaagaagugcgacguccccugcaucggcaucgagauggugcaugacggcgggaaggagaccuggcacuccgccgccacggccaucuacugccugaugggcagcgggcagcuccugugggacaccgugaccggcgucgacauggcccuguga

SEQ ID NO: 30225 - RNA, 1401 nt, Artificial Sequence; identical to SEQ ID NO: 28640
  derived and/or modified CDS sequence (AUadapt) from InfluenzaB__AHL93261__NA

SEQ ID NO: 30226 - RNA, 1401 nt, Artificial Sequence; identical to SEQ ID NO: 28640
  derived and/or modified CDS sequence (AUadapt) from InfluenzaB__AHL93272__NA

SEQ ID NO: 30227 - RNA, 1401 nt, Artificial Sequence; identical to SEQ ID NO: 28640
  derived and/or modified CDS sequence (AUadapt) from InfluenzaB__AHL93283__NA

SEQ ID NO: 30228 - RNA, 1401 nt, Artificial Sequence; identical to SEQ ID NO: 28640
  derived and/or modified CDS sequence (AUadapt) from InfluenzaB__AHL93294__NA

SEQ ID NO: 30229 - RNA, 1401 nt, Artificial Sequence
  derived and/or modified CDS sequence (AUadapt) from InfluenzaB__AHL93305__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucguggccugcggccccaacgaguguaagcacuucgcccugacccacuacgccgcgcagcccggcggguacuacaauggcacccgcggggaccggaacaagcugcgccaccucaucagcgugaagcugggcaagaucccgacggucgagaacuccaucuuccauauggccgccuggagcggguccgccugccacgacggcaaggaguggaccuacaucggcguggacgggcccgauaacaacgcccugcucaaggugaaguacggcgaggcguacaccgacaccuaccauucguacgccaacaagauccugcggacgcaggaguccgccugcaacugcaucgggggcaauugcuaccugaugaucaccgacggcagcgccagcggggucuccgagugucgcuuccucaagauccgggagggccgcaucaucaaggagaucuuccccaccgggcgggugaagcacaccgaggagugcacgugcggcuucgccaguaacaagaccaucgagugcgcgugccgcgacaacuccuacaccgccaagcggcccuuugugaagcugaacgucgagaccgacacggccgagauccgccugaugugcaccgacaccuaccucgacaccccgcggcccaaugacgggagcaucacgggccccugcgaguccaacggcgacaaggggucgggcgggaucaagggcggguuugugcaccagcgcauggaguccaagaucggccggugguacagccgcaccauguccaagaccgagcggaugggcauggggcuguacgugaaguacgacggcgaucccugggccgacagcgacgcccuggcguucuccggggucauggugagcaugaaggagccgggcugguacuccuuuggguucgagaucaaggacaagaagugcgacgugcccugcaucggcaucgagaugguccacgauggcgggaaggagaccuggcacagcgccgccacggccaucuacugccucaugggcuccgggcagcugcugugggacaccgugaccggcguggacauggcccucuga

SEQ ID NO: 30230 - RNA, 1401 nt, Artificial Sequence; identical to SEQ ID NO: 28640
  derived and/or modified CDS sequence (AUadapt) from InfluenzaB__AHL93316__NA

SEQ ID NO: 30231 - RNA, 1401 nt, Artificial Sequence
  derived and/or modified CDS sequence (AUadapt) from InfluenzaB__AHL93338__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaacgaguguaagcacuucgcccugacccacuacgccgcgcagcccggcggguacuacaauggcacccgcggggaccggaacaagcugcgccaccucaucagcgugaagcugggcaagaucccgacgguggagaacuccaucuuccauauggccgccuggagcggguccgccugccacgacggcaaggaguggaccuacaucggcgucgacgggcccgauaacaacgcccugcucaaggugaaguacggcgaggcguacaccgacaccuaccauucguacgccaacaagauccugcggacgcaggaguccgccugcaacugcaucgggggcaauugcuaccugaugaucaccgacggcagcgccagcgggguguccgagugucgcuuccucaagauccgggagggccgcaucaucaaggagaucuuccccaccgggcgggucaagcacaccgaggagugcacgugcggcuucgccaguaacaagaccaucgagugcgcgugccgcgacaacuccuacaccgccaagcggcccuuugugaagcugaacguggagaccgacgccgccgagauccgccugaugugcacggacaccuaccucgacaccccgcggcccaaugacgggagcaucaccggccccugcgaguccaacggcgacaaggggucgggcgggaucaagggcggguuuguccaccagcgcauggaguccaagaucggccggugguacagccgcacgauguccaagaccgagcggaugggcauggggcuguacgugaaguacgacggcgaucccugggccgacagcgacgcgcuggccuucuccggggugauggucagcaugaaggagccgggcugguacuccuuuggguucgagaucaaggacaagaagugcgacgugcccugcaucggcaucgagauggugcacgauggcgggaaggagaccuggcacagcgccgccaccgccaucuacugccucaugggcuccgggcagcugcugugggacacggucaccggcguggacauggcgcucuga

SEQ ID NO: 30232 - RNA, 1401 nt, Artificial Sequence
  derived and/or modified CDS sequence (AUadapt) from InfluenzaB__AHL93349__NA
augcugcccaguaccauccagacccucacgcuguuccugaccuccggcggggugcuccugagccuguacgucuccgccucgcucuccuaccugcuguacagcgauauccuccugaaguucuccccgaccgagaucaccgcccccacgaugccccuggacugcgcgaacgccucgaacgugcaggccgugaaccgcuccgccaccaagggcgucacccuccugcugcccgagccggaguggaccuacccccggcucaguugccagggguccacguuccagaaggcccugcugaucagcccccaccgcuucggcgagaccaaggggaacuccgcgccccucaucauccgggagccguucaucgccugcggccccaaugagugcaagcacuucgcccugacccacuacgccgcgcagcccggcggguacuacaacggcacccgcggggaucggaacaagcugcgccaccucaucucggugaagcugggcaagauccccacgguggagaacuccaucuuccacauggccgccuggagcggguccgccugccaugacggcaaggaguggaccuacaucggcgucgacgggccggacaacaacgcccugcucaaggugaaguacggcgaggcguacaccgauaccuaccacucguacgccaacaagauccugcggacgcaggaguccgccugcaacugcaucgggggcaauugcuaccugaugaucaccgacggcagcgccucggggguguccgagugccgcuuccucaagauccgggagggccgcaucaucaaggagaucuuucccaccgggcgggucaagcacaccgaggagugcacgugcggcuucgccagcaacaagaccaucgagugcgcgugccgcgauaacuccuacaccgccaagcggcccuucgugaagcugaacguggagaccgacacggccgagauccgccugaugugcaccgacaccuaccucgauacgccccggccgaacgacgggagcaucaccggccccugcgaguccaacggcgacaaggggucgggcgggaucaagggcggguucguccaucagcgcauggaguccaagaucggccggugguacagccgcaccauguccaagaccgagcggaugggcauggagcuguacgugaaguacgacggggaccccugggccgacucggaugcccuggcguucuccggcgugauggucagcaugaaggagcccgggugguacuccuucggcuucgagaucaaggacaagaagugcgacgugccguguaucgggaucgagauggugcacgacggcggcaaggagaccuggcacagcgccgccacggccaucuacugccucaugggguccggccagcugcugugggacaccgucaccggggugaacauggcccucuga

SEQ ID NO: 30233 - RNA, 1401 nt, Artificial Sequence; identical to SEQ ID NO: 28640
  derived and/or modified CDS sequence (AUadapt) from InfluenzaB__AHL93371__NA

SEQ ID NO: 30234 - RNA, 1401 nt, Artificial Sequence
  derived and/or modified CDS sequence (AUadapt) from InfluenzaB__AHL93382__NA
augcugcccaguaccauccagacccucacgcuguuccugaccuccggcggggugcuccugagccuguacgucuccgccucgcucuccuaccugcuguacagcgauauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuauccccggcucucgugccccggguccacguuccagaaggcccugcugaucagcccccaccgcuucggcgagaccaaggggaacuccgcgccgcucaucauccgggagcccuuuaucgccugcggccccaacgagugcaagcacuucgcccugacccacuacgccgcgcagcccggcggguacuauaacggcacccgcggggaccggaacaagcugcgccaccucaucagcgugaagcugggcaagaucccgacgguggagaacuccaucuuccauauggccgccuggucgggguccgccugccacgacggcaaggaguggaccuacaucggcgucgacgggcccgacaauaacgcccugcucaaggugaaguacggcgaggcguacaccgacaccuaccacagcuaugccaacaagauccugcggacgcaggaguccgccugcaacugcaucgggggcaacugcuaccugaugaucaccgacggcagugccagcgggguguccgagugccgcuuccucaagauccgggagggccgcaucaucaaggagaucuuccccaccgggcgggucaagcacaccgaggagugcacgugcggcuuugccagcaacaagaccaucgagugcgcgugccgcgacaacuccuacaccgccaagcggcccuuugugaagcugaacguggagaccgacacggccgagauccgccugaugugcaccgacaccuaccucgacaccccgcggcccaacgaugggucgaucacgggccccugcgaguccaacggcgacaaggggagcggcgggaucaagggcggguucguccaccagcgcauggaguccaagaucggccggugguacagucgcaccauguccaagaccgagcggaugggcauggagcuguacgugaaguacgacggggaccccugggccgacucggacgcccuggcguuuuccggcgugauggucagcaugaaggagccggggugguacuccuucggcuucgagaucaaggacaagaagugcgacgugcccuguaucgggaucgagauggugcacgacggcggcaaggagaccuggcacagcgccgccacggccaucuacugccucaugggguccggccagcugcugugggacaccgucaccggggugaacauggcccucuga

SEQ ID NO: 30235 - RNA, 1401 nt, Artificial Sequence; identical to SEQ ID NO: 28640
  derived and/or modified CDS sequence (AUadapt) from InfluenzaB__AHL93393__NA

SEQ ID NO: 30236 - RNA, 1401 nt, Artificial Sequence; identical to SEQ ID NO: 28640
  derived and/or modified CDS sequence (AUadapt) from InfluenzaB__AHL93404__NA

SEQ ID NO: 30237 - RNA, 1401 nt, Artificial Sequence; identical to SEQ ID NO: 28640
  derived and/or modified CDS sequence (AUadapt) from InfluenzaB__AHL93415__NA

SEQ ID NO: 30238 - RNA, 1401 nt, Artificial Sequence; identical to SEQ ID NO: 28640
  derived and/or modified CDS sequence (AUadapt) from InfluenzaB__AHL93426__NA

SEQ ID NO: 30239 - RNA, 1401 nt, Artificial Sequence; identical to SEQ ID NO: 28640
  derived and/or modified CDS sequence (AUadapt) from InfluenzaB__AHL93437__NA

SEQ ID NO: 30240 - RNA, 1401 nt, Artificial Sequence; identical to SEQ ID NO: 30234
  derived and/or modified CDS sequence (AUadapt) from InfluenzaB__AHL93448__NA

SEQ ID NO: 30241 - RNA, 1404 nt, Artificial Sequence
  derived and/or modified CDS sequence (AUadapt) from InfluenzaB__AHL93459__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaacgugcaggccgugaaucgcuccgccaccaagggcgucacccuccugcugcuccccgagccggaguggaccuacccccggcugagcugccccggguccacguuccagaaggcccugcucaucagcccccaccgcuucggcgagaccaaggggaauuccgcgccgcugaucauccgggagcccuucaucgccugcggccccaacgagugcaagcacuucgcccugacccacuaugccgcgcagcccggcggguacuacaacggcacccgcggggaccggaacaagcuccgccaccugaucagugugaagcugggcaagaucccgacgguggagaacuccaucuuccacauggccgccuggagcggguccgccugccacgacggcaaggaguggaccuauaucggcgucgacgggcccgacaacaacgcccuccugaaggugaaguacggcgaggcguacaccgacaccuaucacagcuacgccaacaagauccugcggacgcaggaguccgccugcaacugcaucgggggcaauugcuaccucaugaucaccgacggcagcgccucggggguguccgagugccgcuuucugaagauccgggagggccgcaucaucaaggagaucuuccccaccgggcgggucaagcacaccgaggagugcacgugcggcuucgccagcaacaagaccaucgagugugcgugccgcgacaacuccuacaccgccaagcggcccuucgugaagcugaacguggagaccgacacggccgagauccgccucauguguaccgacaccuaccuggacaccccgcggcccaacgacgggagcaucacgggccccugcgaguccaauggcgacaaggggagcggcgggaucaagggcggguucguccaccagcgcauggaguccaagaucggccggugguacucgcgcaccauguccaagaccgagcggaugggcauggggcuguaugugaaguacgacggcgaccccugggccgacagcgacgcccucgcguucuccggggugauggucaguaugaaggagccgggcugguacuccuucggguucgagaucaaggacaagaagugcgacgugcccugcaucggcaucgagauggugcaugacggcgggaaggagaccuggcacagcgccgccacggccaucuacugccugaugggcuccgggcagcugcucugggacaccgucaccggcguggacauggcccuguga

SEQ ID NO: 30242 - RNA, 1401 nt, Artificial Sequence
  derived and/or modified CDS sequence (AUadapt) from InfluenzaB__AHL93470__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaacgugcaggccgugaaucgcuccgccaccaagggcgucacccuccugcugcccgagccggaguggaccuacccccggcucagcugccccggguccacguuccagaaggcccugcugaucucgccccaccgcuucggcgagaccaaggggaauuccgcgccgcucaucauccgggagcccuucaucgccugcggccccaacgagugcaagcacuucgcccugacccacuaugccgcgcagcccggcggguacuacaacggcacccgcggggaccggaacaagcugcgccaccucaucagugugaagcugggcaagaucccgacgguggagaacuccaucuuccacauggccgccuggagcggguccgccugccacgacggcaaggaguggaccuauaucggcgucgacgggcccgacaacaacgcccugcucaaggugaaguacggcgaggcguacaccgacaccuaucacucguacgccaacaagauccugcggacgcaggaguccgccugcaacugcaucgggggcaauugcuaccugaugaucaccgacggcagcgccagcgggguguccgagugccgcuuucucaagauccgggagggccgcaucaucaaggagaucuuccccaccgggcgggucaagcacaccgaggagugcacgugcggcuucgccucgaacaagaccaucgagugugcgugccgcgacaacuccuacaccgccaagcggcccuucgugaagcugaacguggagaccgacacggccgagauccgccugauguguaccgacaccuaccucgacaccccgcggcccaacgacgggagcaucacgggccccugcgaguccaauggcgacaaggggagcggcgggaucaagggcggguucguccaccagcgcauggaguccaagaucggccggugguacucgcgcaccauguccaagaccgagcggaugggcauggggcuguaugugaaguacgacggcgaccccugggccgacagcgacgcccugaccuucuccggggugauggucaguaugaaggagccgggcugguacuccuucggguucgagaucaaggacaagaagugcgacgugcccugcaucggcaucgagauggugcaugacggcgggaaggagacguggcacagcgcggccaccgccaucuacugccucaugggcuccgggcagcugcugugggacaccgucaccggcguggacauggcccucuga

SEQ ID NO: 30243 - RNA, 1401 nt, Artificial Sequence; identical to SEQ ID NO: 29011
  derived and/or modified CDS sequence (AUadapt) from InfluenzaB__AHL93481__NA

SEQ ID NO: 30244 - RNA, 1401 nt, Artificial Sequence; identical to SEQ ID NO: 29069
  derived and/or modified CDS sequence (AUadapt) from InfluenzaB__AHL93492__NA

SEQ ID NO: 30245 - RNA, 1401 nt, Artificial Sequence; identical to SEQ ID NO: 28686
  derived and/or modified CDS sequence (AUadapt) from InfluenzaB__AHL93503__NA

SEQ ID NO: 30246 - RNA, 1401 nt, Artificial Sequence
  derived and/or modified CDS sequence (AUadapt) from InfluenzaB__AHL93514__NA
augcugcccaguaccauccagacccucacgcuguuccugaccuccggcggggugcuccugagccuguacgucuccgccucgcucuccuaccugcuguacagcgauauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuauccccggcucucgugccccggguccacguuccagaaggcccugcugaucagcccccaccgcuucggcgagaccaaggggaacuccgcgccgcucaucauccgggagcccuucaucgccuguggccccaacgagugcaagcacuucgcccugacccacuacgccgcgcagcccggcggguacuauaacggcacccgcggggaccggaacaagcugcgccaccucaucagcaucaagcugggcaagaucccgacgguggagaacuccaucuuccauauggccgccuggucgggguccgccugccacgacggcaaggaguggaccuacaucggcguggacgggcccgacaacaaugcccugcucaaggucaaguacggcgaggcguacaccgacaccuaccacagcuacgccaauaagauccugcggacgcaggaguccgccugcaacugcaucgggggcaacugcuaccugaugaucaccgacggcagugccucggggguguccgagugccgcuuccucaagauccgggagggccgcaucaucaaggagaucuuccccaccgggcgggugaagcacaccgaggagugcacgugcggcuucgccaguaacaagaccaucgagugcgcgugccgcgacaacuccuacaccgccaagcggcccuucgucaagcugaauguggagaccgacacggccgagauccgccugaugugcaccgacaccuaccucgacaccccgcggcccgacgacgggaguaucacgggcuccugcgagucgaacggcgacaagggguccggcgggaucaagggcggguucgugcaccagcgcauggagagcaagaucggccggugguacucccgcaccaugaguaagaccgagcggaugggcauggggcuguacgucaaguacgacggcgaccccugggccgacuccgacgcccugaccuucaguggggugaugguguccaugaaggagcccggcugguacagcuucggguucgagaucaaggacaagaagugcgacgucccguguaucggcaucgagauggugcacgacggcgggaaggagacguggcacuccgcggccaccgccaucuacugccucaugggcagcgggcagcugcugugggacaccgugaccggcgucgacauggcccucuga

SEQ ID NO: 30247 - RNA, 1401 nt, Artificial Sequence; identical to SEQ ID NO: 28686
  derived and/or modified CDS sequence (AUadapt) from InfluenzaB__AHL93525__NA

SEQ ID NO: 30248 - RNA, 1401 nt, Artificial Sequence; identical to SEQ ID NO: 29069
  derived and/or modified CDS sequence (AUadapt) from InfluenzaB__AHL93536__NA

SEQ ID NO: 30249 - RNA, 1401 nt, Artificial Sequence
  derived and/or modified CDS sequence (AUadapt) from InfluenzaB__AHL93558__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccgcgaugccccuggacugcgccaacgccaguaacgugcaggccgugaaccgcuccgccacgaagggcgucacccuccugcugcccgagccggaguggaccuacccccggcucagcugccccggguccaccuuccagaaggcgcugcugaucaguccccaccgcuucggcgagacgaaggggaacuccgccccgcucaucauccgggagcccuucaucgccugcggccccaacgaguguaagcacuucgcccugacccacuacgcggcccagcccggcggguacuacaauggcacccgcggggaccggaacaagcugcgccaccucaucagcgugaagcugggcaagaucccgaccguggagaacuccaucuuccauauggccgccuggagcggguccgccugccacgacggcaaggaguggacguacaucggcgucgacgggcccgauaacaacgcgcugcucaaggugaaguacggcgaggccuacaccgacaccuaccauucguacgccaacaagauccugcggacccaggaguccgccugcaacugcaucgggggcaauugcuaccugaugaucacggacggcagcgccagcgggguguccgagugucgcuuccucaagauccgggagggccgcaucaucaaggagaucuuccccaccgggcgggucaagcacaccgaggagugcacgugcggcuucgcgaguaacaagaccaucgagugcgccugccgcgacaacuccuacaccgccaagcggcccuuugugaagcugaacguggagaccgacaccgccgagauccgccugaugugcacggacaccuaccucgacaccccgcggcccaaugacgggagcaucaccggccccugcgaguccgacggcgacaaggggucgggcgggaucaagggcggguuuauccaccagcgcauggaguccaagaucggccggugguacagccgcacgauguccaagaccgagcggaugggcauggggcuguacgucaaguacgacggcgaucccugggccgacagcgacgcgcuggccuucuccggggugauggugagcaugaaggagccgggcugguacuccuuuggguucgagaucaaggacaagaagugcgacguccccugcaucggcaucgagauggugcacgauggcgggaaggagaccuggcacagcgccgccaccgccaucuacugccucaugggcuccgggcagcugcugugggacacggugaccggcgucgacauggcgcucuga

SEQ ID NO: 30250 - RNA, 1401 nt, Artificial Sequence
  derived and/or modified CDS sequence (AUadapt) from InfluenzaB__AHL93569__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccgcuccgccaccaagggcgucacccuccugcugcccgagccggaguggaccuacccccggcucagcugccccggguccacguuccagaaggcccugcugaucagcccccaucgcuucggcgagaccaaggggaacuccgcgccgcucaucauccgggagcccuucaucgccugcggccccaacgagugcaagcacuuugcccugacccacuacgccgcgcagcccggcggguacuacaacggcacccgcggggaccggaauaagcugcgccaccucaucucggugaagcugggcaagaucccgacgguggagaacuccaucuuccacauggccgccuggagcggguccgccugucacgacggcaaggaguggaccuacaucggcgucgacgggcccgacaacaacgcccugcucaaggugaaguauggcgaggcguacaccgacaccuaccacagcuacgccaauaagauccugcggacgcaggaguccgccugcaacugcaucgggggcaacugcuaccugaugaucaccgauggcagcgccucggggguguccgagugccgcuuccucaagauccgggagggccgcaucaucaaggagaucuuccccaccgggcgggucaagcacaccgaggaguguacgugcggcuucgccagcaacaagaccaucgagugcgcgugccgcgacaauuccuacaccgccaagcggcccuucgugaagcugaacguggagaccgacacggccgagauccgccugaugugcaccgacaccuaucucgacaccccgcggcccaacgacgggagcaucacgggccccugcgaguccgacggcgauaaggggagcggcgggaucaagggcggguucguccaccagcgcauggaguccaagaucggccggugguacucgcgcaccauguccaagaccgagcggaugggcauggggcuguacgugaaguacgauggcgaccccugggccgacagcgacgcccugaccuucuccggggugauggucagcaugaaggagccgggcugguauuccuucggguucgagaucaaggacaagaagugcgacgugcccugcaucggcaucgagauggugcaugacggcgggaaggagacguggcacagcgcggccaccgccaucuacugccucaugggcuccgggcagcugcugugggacaccgucaccggcguggacauggcccucuga

SEQ ID NO: 30251 - RNA, 1401 nt, Artificial Sequence; identical to SEQ ID NO: 29069
  derived and/or modified CDS sequence (AUadapt) from InfluenzaB__AHL93580__NA

SEQ ID NO: 30252 - RNA, 1401 nt, Artificial Sequence; identical to SEQ ID NO: 29069
  derived and/or modified CDS sequence (AUadapt) from InfluenzaB__AHL93591__NA

SEQ ID NO: 30253 - RNA, 1401 nt, Artificial Sequence
  derived and/or modified CDS sequence (AUadapt) from InfluenzaB__AHL93613__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaacgaguguaagcacuucgcccugacccacuacgccgcgcagcccggcggguacuacaauggcacccgcggggaccggaacaagcugcgccaccucaucagcgugaagcugggcaagaucccgacgguggagaacuccaucuuccauauggccgccuggagcggguccgccugccacgacggcaaggaguggaccuacaucggcgucgacgggcccgauaacaacgcccugcucaaggugaaguacggcgaggcguacaccgacaccuaccauagcuacgccaacaagauccugcggacgcaggaguccgccugcaacugcaucgggggcaauugcuaccugauggugaccgacggcagcgccagcggggucuccgagugucgcuuccucaagauccgggagggccgcaucaucaaggagaucuuccccaccgggcgggugaagcacaccgaggagugcacgugcggcuucgccaguaacaagaccaucgagugcgcgugccgcgacaacuccuacaccgccaagcggcccuuugugaagcugaacgucgagaccgacacggccgagauccgccugaugugcaccgacaccuaccucgacaccccgcggcccgaugacgggagcaucacgggccccugcgaguccaacggcgacaaggggagcggcgggaucaagggcggguuugugcaccagcgcauggaguccaagaucggccggugguacagccgcaccauguccaagaccgagcggaugggcauggggcuguacgugaaguacgacggcgaucccugggccgacagcgacgcccuggucuucuccggggugauggugagcaugaaggagccgggcugguacuccuuuggguucgagaucaaggacaagaagugcgacguccccugcaucggcaucgagauggugcacgauggcgggaaggagaccuggcacagcgcggccacggccaucuacugccucaugggcuccgggcagcugcugugggacaccgugaccggcgucgacauggcccucuga

SEQ ID NO: 30254 - RNA, 1401 nt, Artificial Sequence; identical to SEQ ID NO: 29069
  derived and/or modified CDS sequence (AUadapt) from InfluenzaB__AHL93624__NA

SEQ ID NO: 30255 - RNA, 1401 nt, Artificial Sequence; identical to SEQ ID NO: 30253
  derived and/or modified CDS sequence (AUadapt) from InfluenzaB__AHL93635__NA

SEQ ID NO: 30256 - RNA, 1401 nt, Artificial Sequence; identical to SEQ ID NO: 30253
  derived and/or modified CDS sequence (AUadapt) from InfluenzaB__AHL93646__NA

SEQ ID NO: 30257 - RNA, 1401 nt, Artificial Sequence; identical to SEQ ID NO: 28686
  derived and/or modified CDS sequence (AUadapt) from InfluenzaB__AHL93657__NA

SEQ ID NO: 30258 - RNA, 1401 nt, Artificial Sequence; identical to SEQ ID NO: 29069
  derived and/or modified CDS sequence (AUadapt) from InfluenzaB__AHL93668__NA

SEQ ID NO: 30259 - RNA, 1401 nt, Artificial Sequence
  derived and/or modified CDS sequence (AUadapt) from InfluenzaB__AHL93679__NA
augcugcccaguaccauccagacccucacgcuguuccugaccuccggcggggugcuccugagccuguacgucuccgcccuccugagcuaccugcucuauuccgacauccugcugaaguucagcccgaccgagaucaccgcccccacgaugucccucgacugcgcgaacgccaguaacgugcaggccgugaaccgcuccgccaccaagggcgucaccuuccugcugcccgagcccgaguggaccuacccgcggcucagcugccccggguccacguuucagaaggcccugcugaucucgccccaccgcuucggcgagaccaaggggaacuccgcgccccucaucauccgggagccguucaucgccugcggccccaaugagugcaagcacuucgcccugacccacuacgccgcgcagcccggcggguacuauaacggcacccgcggggaccggaacaagcugcgccaccucaucagcgugaagcugggcaagauccccacgguggagaacuccaucuuucacauggccgccuggagcggguccgccugccacgacggcaaggaguggaccuacaucggcgucgaugggccggacaacgacgcccugcucaaggugaaguacggcgaggcguacaccgacaccuaucacagcuacgccaacaagauccugcggacgcaggaguccgccugcaacuguaucgggggcaacugcuaccugaugaucaccgacggcagcgccagugggguguccgagugccgcuuccucaagauccgggagggccgcaucaucaaggagauccugcccaccgggcgggucaagcacaccgaggagugcacgugcggcuucgccaguaacaagaccaucgagugcgcgugccgcgacaacuccuacaccgccaagcggcccuuugugaagcugaacguggagaccgacacggccgagauccgccucaugugcaccgacaccuaccuggacacgccccggccggaugacgggagcaucaccggccccugcgaguccaacggcgacaaggggagcggcgggaucaagggcggguuuguccaccagcgcauggaguccaagaucggccggugguacagccgcaccauguccaagaccgagcggaugggcauggggcuguacgugaaguacgacggcgaucccugggccgacagcgacgcccucgcguucuccggggugauggucagcaugaaggagcccggcugguacuccuuuggguucgagaucaaggacaagaagugcgacgugccgugcaucggcaucgagauggugcacgauggcgggaaggagaccuggcacagcgccgccacggccaucuacugccugaugggcuccgggcagcugcucugggacaccgucaccggcguggacauggcccuguga

SEQ ID NO: 30260 - RNA, 1401 nt, Artificial Sequence; identical to SEQ ID NO: 30253
  derived and/or modified CDS sequence (AUadapt) from InfluenzaB__AHL93690__NA

SEQ ID NO: 30261 - RNA, 1401 nt, Artificial Sequence; identical to SEQ ID NO: 30253
  derived and/or modified CDS sequence (AUadapt) from InfluenzaB__AHL93701__NA

SEQ ID NO: 30262 - RNA, 1401 nt, Artificial Sequence; identical to SEQ ID NO: 30253
  derived and/or modified CDS sequence (AUadapt) from InfluenzaB__AHL93712__NA

SEQ ID NO: 30263 - RNA, 1401 nt, Artificial Sequence
  derived and/or modified CDS sequence (AUadapt) from InfluenzaB__AHL93723__NA
augcugcccaguaccauccagaugcucacccuguuccugacguccggcggggugcuccugagccuguacgucuccgccagccucuccuaccugcuguacagugacauccuccugaaguucuccccgaccgagaucaccgcccccaccaugccccuggacugcgcgaacgccagcaaugugcacgccgugaaccgcuccgccacgaagggcgucaccuuccuccugcccgagccggaguggaccuacccccggcugagcugccccggguccaccuuccagaaggcccuccugaucaguccccaccgcuucggcgagacgaaggggaacuccgcgccgcugaucauccgggagcccuucaucgccugcggccccaacgaguguaagcacuucgcccucacccacuacgccgcgcagcccggcggguacuacaacggcacccgcggggaucggaacaagcugcgccaccugaucagcgugaagcucggcaagaucccgaccguggagaacuccaucuuccacauggccgccuggaguggguccgccugccacgacggcaaggaguggacguacaucggcgucgacgggcccgacaacaaugcccugcugaagaucaaguacggcgaggcguacaccgacaccuaccacucguaugccaacaacauccuccggacccaggaguccgccugcaacugcaucgggggcaacugcuaucugaugaucacggacggcagcgccagcgggguguccgagugccgcuuccugaagauccgggagggccgcaucaucaaggagaucuuccccaccgggcgggugaagcauaccgaggagugcacgugcggcuucgccucgaacaagaccaucgagugcgcgugccgcgauaacuccuacaccgccaagcggcccuucgucaagcucaacguggagaccgacaccgccgagauccgccugaugugcacggauaccuaccuggacaccccgcggcccgacgacgggagcaccacgggccccugcgaguccaacggcgauaaggggagcggcgggaucaagggcggguucgugcaccagcgcauggccuccaagaucggccggugguacucgcgcaccauguccaagaccgagcggaagggcauggggcucuacgucaaguaugacggcgaccccuggaccgacagcgacgcccuggcguuccgcggggugaugguguccaugaaggagccgggcugguacaguuucggguucgagaucaaggacaagaagugcgacguccccugcaucggcaucgagauggugcaugacggcgggaaggagacguggcacuccgccgccaccgccaucuacugccugaugggcagcgggcagcuccugugggacaccgugaccggcgucgacauggcccuguga

SEQ ID NO: 30264 - RNA, 1401 nt, Artificial Sequence; identical to SEQ ID NO: 29069
  derived and/or modified CDS sequence (AUadapt) from InfluenzaB__AHL93734__NA

SEQ ID NO: 30265 - RNA, 1401 nt, Artificial Sequence
  derived and/or modified CDS sequence (AUadapt) from InfluenzaB__AHL93745__NA
augcugcccaguaccauccagaugcucacccuguuccugacguccggcggggugcuccugagccuguacgucuccgccagccucuccuaccugcuguacagugacauccuccugaaguucuccccgaccgagaucaccgcccccaccaugccccuggacugcgcgaacgccagcaaugugcacgccgugaaccgcuccgccacgaagggcgucaccuuccuccugcccgagccggaguggaccuacccccggcugagcugccccggguccaccuuccagaaggcccuccugaucaguccccaccgcuucggcgagacgaaggggaacuccgcgccgcugaucauccgggagcccuucaucgccugcggccccaacgaguguaagcacuucgcccucacccacuacgccgcgcagcccggcggguacuacaacggcacccgcggggaucggaacaagcugcgccaccugaucucggugaagcucggcaagaucccgaccguggagaacuccaucuuccacauggccgccuggaguggguccgccugccacgacggcaaggaguggacguacaucggcgucgacgggcccgacaacaaugcccugcugaagaucaaguacggcgaggcguacaccgacaccuaccacagcuaugccaacaacgugcuccggacccaggaguccgccugcaacugcaucgggggcaacugcuaucugaugaucacggacggcagcgccucggggguguccgagugccgcuuccugaagauccgggagggccgcaucaucaaggagaucuuccccaccgggcgggucaagcauaccgaggagugcacgugcggcuucgccagcaacaagaccaucgagugcgcgugccgcgauaacuccuacaccgccaagcggcccuucgugaagcucaacguggagaccgacaccgccgagauccgccugaugugcacggauaccuaccuggacaccccgcggcccgacgacgggagcaucaccggccccugcgaguccaacggcgauaaggggagcggcgggaucaagggcggguucguccaccagcgcauggccuccaagaucggccggugguacucgcgcacgauguccaagaccgagcggaagggcauggggcucuacgugaaguaugacggcgaccccuggaccgacagcgacgcccuggcguuccgcggggugauggucuccaugaaggagccgggcugguacaguuucggguucgagaucaaggacaagaagugcgacgugcccugcaucggcaucgagauggugcaugacggcgggaaggagaccuggcacuccgccgccacggccaucuacugccugaugggcagcgggcagcuccugugggacaccgucaccggcguggacauggcccuguga

SEQ ID NO: 30266 - RNA, 1401 nt, Artificial Sequence; identical to SEQ ID NO: 29232
  derived and/or modified CDS sequence (AUadapt) from InfluenzaB__AHL93756__NA

SEQ ID NO: 30267 - RNA, 1401 nt, Artificial Sequence; identical to SEQ ID NO: 30253
  derived and/or modified CDS sequence (AUadapt) from InfluenzaB__AHL93767__NA

SEQ ID NO: 30268 - RNA, 1401 nt, Artificial Sequence
  derived and/or modified CDS sequence (AUadapt) from InfluenzaB__AHL93778__NA
augcugcccaguaccauccagacccucauccuguuccugacguccggcggggugcuccugagccuguacgucuccgcccuccugagcuaccugcucuacuccgacauccugcugaaguuuagcccgaccgagaucaccgcccccaccaugucccucgacugcgcgaacgccagcaacgugcaggccgugaaccgcuccgccacgaagggcgucaccuuucugcugcccgagcccgaguggaccuacccgcggcucagcugccccggguccaucuuccagaaggcccugcugaucucgccccaccgcuucggcgagaccaaggggaacuccgcgccccucaucauccgggagccguuuaucgccugcggccccaacgagugcaagcacuucgcccugacgcacuacgccgcgcagcccggcggguauuacaacggcacccgcggggaccggaacaagcugcgccaccucaucagcgugaagcugggcaagauccccaccguggagaacuccaucuuucacauggccgccuggagcggguccgccugccacgacggcaaggaguggaccuacaucggcgucgacgggccggacaaugacgcccugcucaaggugaaguacggcgaggcguacacggacaccuaccacagcuaugccaacaagauccugcggacccaggaguccgccugcaacugcaucgggggcaacugcuaccugaugaucaccgauggcagcgccagcgggguguccgagugccgcuuccucaagauccgggagggccgcaucaucaaggagaucuuccccacggggcgggucaagcacaccgaggagugcacgugcggcuuugccucgaacaagaccaucgagugcgcgugccgcgacaacuccuacaccgccaagcggcccuuugugaagcugaacguggagaccgacaccgccgagauccgccugaugugcaccgacacguaccucgacacgccccggccggacgaugggagcaucaccggccccugcgaguccaacggcgacaaggggagcggcgggaucaagggcggguucguccaccagcgcauggaguccaagaucggccggugguacagucgcaccauguccaagaccgagcggaugggcauggggcuguacgugaaguacgacggcgaccccugggccgacagcgacgcccuggcguuuuccggggugauggucagcaugaaggagcccggcugguacuccuucggguucgagaucaaggacaagaagugcgacgugccguguaucggcaucgagauggugcacgacggcgggaaggagaccuggcacagcgccgccaccgccaucuacugccucaugggcuccgggcagcugcugugggacaccgucacgggcguggacauggcccucuga

SEQ ID NO: 30269 - RNA, 1401 nt, Artificial Sequence
  derived and/or modified CDS sequence (AUadapt) from InfluenzaB__AHL93789__NA
augcugcccaguaccauccagacccucacgcuguuccugaccuccggcggggugcuccugagccuguacgucuccgccagccucuccuaccugcuguauagcgacauccuccugaaguucuccccgaccggcaucaccgcccccacgaugccccuggacugcgcgaacgccaguaacgugcaggccgugaaccgcuccgccaccaagggggucacccuccugcugcccgagccggaguggaccuacccccggcucagcugccccggcuccacguuucagaaggcccugcugaucagcccccaccgcuucggggagaccaagggcaacuccgcgccgcucaucauccgggagcccuucaucgccugcggccccaaugagugcaagcacuucgcccugacccacuacgccgcgcagcccgggggcuauuacaacgggacccgcggcgaccggaacaagcugcgccaccucaucagcgugaagcuggggaagaucccgacgguggagaauuccaucuuccacauggccgccuggagcggcuccgccugccacgauggcaaggaguggaccuacaucggggucgacggccccgacaacaacgcccugcucaaggugaaguacggggaggcguauaccgacaccuaccacucguacgccaauaagauccugcggacgcaggaguccgccugcaacugcaucggcggcaacugcuaccugauggugaccgaugggagcgccagcggcgucuccgagugccgcuuccucaagauccgggaggggcgcaucaucaaggagaucuuccccaccggccgggugaagcauaccgaggagugcacgugcggguucgccagcaacaagaccaucgagugcgcgugucgcgacaacuccuacaccgccaagcggcccuucgugaagcugaacgucgagaccgauacggccgagauccgccugaugugcaccgacaccuaccucgacaccccgcggcccgacgacggcaguaucacgggccccugcgaguccaacggggacaagggcagcgggggcaucaagggcggguucgugcaucagcgcauggaguccaagaucggccggugguacagccgcaccauguccaagaccgagcggauggggaugggccuguacgugaaguacgacggggaccccugggccgauagcgacgcccuggucuucuccggcgugauggugagcaugaaggagccggggugguacuccuuuggcuucgagaucaaggacaagaagugcgacguccccugcaucggcaucgagauggugcacgaugggggcaaggagaccuggcacagcgcggccacggccaucuacugccucaugggguccggccagcugcugugggacaccgugaccggcgucgacauggcccucuga

SEQ ID NO: 30270 - RNA, 1401 nt, Artificial Sequence; identical to SEQ ID NO: 29069
  derived and/or modified CDS sequence (AUadapt) from InfluenzaB__AHL93800__NA

SEQ ID NO: 30271 - RNA, 1401 nt, Artificial Sequence; identical to SEQ ID NO: 29069
  derived and/or modified CDS sequence (AUadapt) from InfluenzaB__AHL93811__NA

SEQ ID NO: 30272 - RNA, 1401 nt, Artificial Sequence; identical to SEQ ID NO: 29605
  derived and/or modified CDS sequence (AUadapt) from InfluenzaB__AHL93822__NA

SEQ ID NO: 30273 - RNA, 1401 nt, Artificial Sequence; identical to SEQ ID NO: 29069
  derived and/or modified CDS sequence (AUadapt) from InfluenzaB__AHL93833__NA

SEQ ID NO: 30274 - RNA, 1401 nt, Artificial Sequence
  derived and/or modified CDS sequence (AUadapt) from InfluenzaB__AHL93844__NA
augcugcccaguaccauccagacccucacgcuguuccugaccuccggcggggugcuccugagccuguacgucuccgccagccucuccuaccugcuguauagcggcauccuccugaaguucuccccgaccgagaucaccgcccccacgaugccccuggacugcgcgaacgccaguaacgugcaggccgugaaccgcuccgccaccaaggaggucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaaugagugcaagcacuucgcccugacccacuacgccgcgcagcccggcggguacuauaacggcacccgcggggaccggaacaagcugcgccaccucaucagcgugaagcugggcaagaucccgacgguggagaauuccaucuuccacauggccgccuggagcggguccgccugccacgacggcaaggaguggaccuauaucggcgucgacgggcccgacgacaacgcccugcucaaggugaaguacggcgaggcguauaccgacaccuaccacagcuacgcccacaagauccugcggacgcaggaguccgccuguaacugcaucgggggcaacugcuaccugaugaucaccgauggcagcgccagcgggguguccgagugccgcuuccucaagauccgggagggccgcaucaucaaggagaucuuccccaccgggcgggucaagcacaccgaggaguguacgugcggcuucgccucgaacaagaccaucgagugcgcgugucgcgacaacuccuacaccgccaagcggcccuucgugaagcugaacguggagaccgacacggccgagauccgccugauguguaccgacaccuaccucgacaccccgcggcccaacgacgggaguaucacgggccccugcgaguccaacggcgacaaggggagcggcgggaucaagggcggguucguccaccagcgcauggaguccaagaucggccggugguauagccgcaccauguccaagaccgagcggaugggcauggggcuguacgugaaguacgacggcgaccccugggccgauagcgacgcccuggcguucuccggggugauggucagcaugaaggagccgggcugguacuccuucggguuugagaucaaggacaagaagugcgacgugcccugcaucggcaucgagauggugcacgauggcgggaaggagaccuggcacagcgccgccacggccaucuacugccucaugggcuccgggcagcugcugugggacaccgucaccggcguggacauggcccucuga

SEQ ID NO: 30275 - RNA, 1401 nt, Artificial Sequence; identical to SEQ ID NO: 29069
  derived and/or modified CDS sequence (AUadapt) from InfluenzaB__AHL93855__NA

SEQ ID NO: 30276 - RNA, 1401 nt, Artificial Sequence; identical to SEQ ID NO: 29069
  derived and/or modified CDS sequence (AUadapt) from InfluenzaB__AHL93866__NA

SEQ ID NO: 30277 - RNA, 1401 nt, Artificial Sequence; identical to SEQ ID NO: 29069
  derived and/or modified CDS sequence (AUadapt) from InfluenzaB__AHL93877__NA

SEQ ID NO: 30278 - RNA, 1401 nt, Artificial Sequence; identical to SEQ ID NO: 29069
  derived and/or modified CDS sequence (AUadapt) from InfluenzaB__AHL93888__NA

SEQ ID NO: 30279 - RNA, 1401 nt, Artificial Sequence
  derived and/or modified CDS sequence (AUadapt) from InfluenzaB__AHL93899__NA
augcugcccaguaccauccagaugcucacccuguuccugacguccggcggggugcuccugagccuguacgucuccgccucgcucuccuaccugcuguacagugacauccuccugaaguucuccccgaccgagaucaccgcccccaccaugccccuggacugcgcgaacgccagcaacgugcaugccgugaaccgcuccgccacgaagggcgucaccuuccuccugcccgagccggaguggaccuacccccggcugucgugccccggguccaccuuccagaaggcccuccugaucagcccccaucgcuucggcgagacgaaggggaacuccgcgccgcugaucauccgggagcccuucaucgccugcgagcccaacgagugcaagcacuuugcccucacccacuacgccgcgcagcccggcggcuacuacaacgggacccgcggcgaccggaacaagcugcgccaucugaucagcgugaagcucgggaagaucccgaccguggagaacuccaucuuccacauggccgccuggucgggcuccgccugccacgaugggaaggaguggacguacaucggcgucgacggccccgacaacaacgcccugcugaagaucaaguacggggaggcguacaccgauaccuaccacagcuacgccaacaacauccuccggacccaggaguccgccugcaauugcaucggcgggaacugcuaccugaugaucacggacggcucggccagcggcguguccgagugucgcuuccugaagauccgggaggggcgcaucaucaaggagaucuuccccaccggccgggugaagcacaccgaggagugcacgugcggguucgccagcaauaagaccaucgagugcgcgugccgcgacaacuccuacaccgccaagcggcccuucgucaagcucaacguggagaccgauaccgccgagauccgccugaugugcacggacaccuaccuggacaccccgcggcccgacgacggcucgaccacggggcccugugaguccaacggcgacaagggcagcgggggcaucaagggcggguucgugcaccagcgcauggccuccaagaucgggcggugguacagccgcaccauguccaagaccgagcggaagggcaugggccucuaugucaaguacgacggggaccccuggaccgacucggacgcccuggcguuccgcggcgugaugguguccaugaaggagccggggugguauagcuucggcuucgagaucaaggacaagaagugcgacguccccugcaucgggaucgagauggugcaugacggcggcaaggagacguggcacuccgccgccaccgccaucuacugccugauggggagcggccagcuccugugggacaccgugaccggggucgacauggcccuguga

SEQ ID NO: 30280 - RNA, 1401 nt, Artificial Sequence
  derived and/or modified CDS sequence (AUadapt) from InfluenzaB__AHL93910__NA
augcugcccaguaccauccagaugcucacccuguuccugacguccggcggggugcuccugagccuguacgucuccgccagccucuccuaccugcuguacagugacauccuccugaaguucuccccgaccgagaucaccgcccccaccaugccccuggacugcgcgaacgccagcaacgugcaugccgugaaccgcuccgccacgaagggcgucaccuuccuccugcccgagccggaguggaccuacccccggcugagcugccccggguccaccuuccagaaggcccuccugaucucgccccaucgcuucggcgagacgaaggggaacuccgcgccgcugaucauccgggagcccuucaucgccugcggccccaacgagugcaagcacuuugcccucacccacuacgccgcgcagcccggcggguacuacaacggcacccgcggggaccggaacaagcugcgccaucugaucagcgugaagcucggcaagaucccgaccguggagaacuccaucuuccacauggccgccuggagcggguccgccugccacgauggcaaggaguggacguacaucggcgucgacgggcccgacaacaacgcccugcugaagaucaaguacggcgaggcguacaccgauaccuaccacucguacgccaacaacauccuccggacccaggaguccgccugcaauugcaucgggggcaacugcuaccugaugaucacggacggcagcgccagugggguguccgagugccgcuuccugaagauccgggagggccgcaucaucaaggagaucuuccccaccgggcgggugaagcacaccgaggagugcacgugcggcuucgccaguaacaagaccaucgagugcacgugccgcgacaacuccuacaccgcgaagcggcccuucgucaagcucaauguggagaccgacaccgccgagauccgccugaugugcaccgacaccuaccuggacaccccgcggcccgacgacgggggcaucacgggccccugugagagcaacggggacaagggcuccgggggcaucaagggcggguucgugcaccagcgcauggccagcaagaucggccggugguacucccgcaccaugaguaagaccgagcggaaggggaugggccucuacgucaaguacgacggggaccccuggaccgacuccgacgcccuggccuuccgcggcgugauggugaguaugaaggagccggggugguacuccuucggcuucgagaucaaggacaagaagugcgacguccccugcaucggcaucgagauggugcaugacgggggcaaggagacguggcacagcgcggccaccgccaucuacugccugaugggguccggccagcuccugugggacaccgugaccggcgucgacauggcccuguga

SEQ ID NO: 30281 - RNA, 1401 nt, Artificial Sequence; identical to SEQ ID NO: 29069
  derived and/or modified CDS sequence (AUadapt) from InfluenzaB__AHL93921__NA

SEQ ID NO: 30282 - RNA, 1401 nt, Artificial Sequence
  derived and/or modified CDS sequence (AUadapt) from InfluenzaB__AHL93932__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaacgaguguaagcacuucgcccugacccacuacgccgcgcagcccggcggguacuacaauggcacccgcggggaccggaacaagcugcgccaccucaucagcgugaagcugggcaagaucccgacgguggagaacuccaucuuccauauggccgccuggagcggguccgccugccacgacggcaaggaguggaccuacaucggcgucgacgggcccgauaacaacgcccugcucaaggugaaguacggcgaggcguacaccgacaccuaccauucguacgccaacaagauccugcggacgcaggaguccgccugcaacugcaucgggggcaauugcuaccugauggugaccgacggcagcgccagcggggucuccgagugucgcuuccucaagauccgggagggccgcaucaucaaggagaucuuccccaccgggcgggugaagcacaccgaggagugcacgugcggcuucgccaguaacaagaccaucgagugcgcgugccgcgacaacuccuacaccgccaagcggcccuuugugaagcugaacgucgagaccgacacggccgagauccgccugaugugcaccgacaccuaccucgacaccccgcggcccgaugacgggagcaucacgggccccugcgaguccaacggcgacaaggggucgggcgggaucaagggcggguuugugcaccagcgcauggaguccaagaucggccggugguacagccgcaccauguccaagaccgagcggaugggcauggagcuguacgugaaguacgacggggaucccugggccgacagcgacgcccuggcguucuccggcgucauggugagcaugaaggagccggggugguacuccuuuggcuucgagaucaaggacaagaagugcgacgugcccugcaucgggaucgagaugguccacgauggcggcaaggagaccuggcacagcgccgccacggccaucuacugccucaugggguccggccagcugcugugggacaccgugaccgggguggacauggcccucuga

SEQ ID NO: 30283 - RNA, 1401 nt, Artificial Sequence; identical to SEQ ID NO: 29232
  derived and/or modified CDS sequence (AUadapt) from InfluenzaB__AHL93943__NA

SEQ ID NO: 30284 - RNA, 1401 nt, Artificial Sequence; identical to SEQ ID NO: 29069
  derived and/or modified CDS sequence (AUadapt) from InfluenzaB__AHL93954__NA

SEQ ID NO: 30285 - RNA, 1401 nt, Artificial Sequence
  derived and/or modified CDS sequence (AUadapt) from InfluenzaB__AHL93965__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccgcgaugccccuggacugcgccaacgccagcaaugugcaggccgugaacugcuccgccacgaagggcgucacccuccugcugcccgagccggaguggaccuacccccgccucagcugccccggguccaccuuccagaaggcgcugcugaucagcccccaucgguucggcgagacgaaggggaacuccgccccgcucaucauccgcgagcccuucaucgccugcggccccaacgagugcaagcauuucgcccugacccacuacgcggcccagcccggcggguacuacaacggcacccgcggggaccggaauaagcugcggcaccucaucucggugaagcugggcaagaucccgaccguggagaacuccaucuuccacauggccgccuggagcggguccgccugucacgacggcaaggaguggacguacaucggcgucgacgggcccgacaacaaugcgcugcucaaggugaaguacggcgaggccuacaccgacaccuaccacagcuacgccaauaagauccugcgcacccaggaguccgccugcaacugcaucgggggcaacugcuaccugaugaucacggauggcagcgccucggggguguccgagugccgguuccucaagauccgcgagggccggaucaucaaggagaucuuccccaccgggcgcgucaagcacaccgaggagugcacguguggcuucgcgagcaacaagaccaucgagugcgccugccgggacaauuccuacaccgccaagcgccccuucgugaagcugaacguggagaccgacaccgccgagauccggcugaugugcacggacaccuaucucgacaccccgcgccccaacgacgggagcaucaccggccccugcgaguccgacggcgacaaggggaauggcgggaucaagggcggguucguccaccagcggauggagagcaagaucggccgcugguacucccggacgaugucgaagaccgagcgcaugggcauggggcuguacgugaaguaugacggcgaccccugggccgacuccgacgcgcuggccuucagcggggugauggucuccaugaaggagccgggcugguacaguuucggguucgagaucaaggacaagaagugcgacgugcccugcaucggcaucgagauggugcaugacggcgggaaggagaccuggcacuccgccgccaccgccaucuacugccucaugggcagcgggcagcugcugugggacacggucaccggcguggacauggcgcucuga

SEQ ID NO: 30286 - RNA, 1401 nt, Artificial Sequence; identical to SEQ ID NO: 28988
  derived and/or modified CDS sequence (AUadapt) from InfluenzaB__AHL93976__NA

SEQ ID NO: 30287 - RNA, 1401 nt, Artificial Sequence; identical to SEQ ID NO: 30259
  derived and/or modified CDS sequence (AUadapt) from InfluenzaB__AHL93987__NA

SEQ ID NO: 30288 - RNA, 1401 nt, Artificial Sequence; identical to SEQ ID NO: 28675
  derived and/or modified CDS sequence (AUadapt) from InfluenzaB__AHL93998__NA

SEQ ID NO: 30289 - RNA, 1401 nt, Artificial Sequence
  derived and/or modified CDS sequence (AUadapt) from InfluenzaB__AHL94009__NA
augcugcccaguaccauccagaugcucacccuguuccugacguccggcggggugcuccugagccuguacgucuccgccagccucuccuaccugcuguacagugacauccuccugaaguucuccccgaccgagaucaccgcccccaccaugccccuggacugcgcgaacgccagcaaugugcacgccgugaaccgguccgccacgaagggcgucaccuuccuccugcccgagccgaaguggaccuacccccggcugagcugccccggguccaccuuccagaaggcccuccugaucaguccccaccgcuucggcgagacgaaggggaacuccgcgccgcugaucauccgggagcccuucaucgccugcggccccaacgagugucgccacuucgcccucacccacuacgccgcgcagcccggcggguacuacaacggcacccgcggggaucggaacaagcugcggcaccugaucucggugaagcucggcaagaucccgaccguggagaacuccaucuuccacauggccgccuggaguggguccgccugccacgacggcaaggaguggacguacaucggcgucgacgggcccgacaacaaugcccugcugaagaucaaguacggcgaggcguacaccgacaccuaccacagcuaugccaacaacauccuccgcacccaggaguccgccugcaacugcaucgggggcaacugcuaucugaugaucacggacggcagcgccucggggguguccgagugccgguuccugaagauccgcgagggccggaucaucaaggagaucuuccccaccgggcgcgugaagcauaccgaggagugcacgugcggcuucgccagcaacaagaccaucgagugcgcgugccgggauaacuccuacaccgccaagcgccccuucgucaagcucaacguggagaccgacaccgccgagauccggcugaugugcacggauaccuaccuggacaccccgcgccccgacgacgggagcaucaccggccccugcgaguccaacggcgauaaggggagcggcgggaucaagggcggguucgugcaccagcggauggccuccaagaucggccgcugguacucgcggacgauguccaagaccgagcgcaagggcauggggcucuacgucaaguaugacggcgaccccuggaccgacagcgacgcccuggcguuccgcggggugaugguguccaugaaggagccgggcugguacaguuucggguucgagaucaaggacaagaagugcgacguccccugcaucggcaucgagauggugcaugacggcgggaaggagaccuggcacuccgccgccacggccaucuacugccugaugggcagcgggcagcuccugugggacaccgugaccggcgucgacauggcccuguga

SEQ ID NO: 30290 - RNA, 1401 nt, Artificial Sequence; identical to SEQ ID NO: 29069
  derived and/or modified CDS sequence (AUadapt) from InfluenzaB__AHL94020__NA

SEQ ID NO: 30291 - RNA, 1401 nt, Artificial Sequence; identical to SEQ ID NO: 29069
  derived and/or modified CDS sequence (AUadapt) from InfluenzaB__AHL94031__NA

SEQ ID NO: 30292 - RNA, 1401 nt, Artificial Sequence; identical to SEQ ID NO: 29232
  derived and/or modified CDS sequence (AUadapt) from InfluenzaB__AHL94042__NA

SEQ ID NO: 30293 - RNA, 1401 nt, Artificial Sequence
  derived and/or modified CDS sequence (AUadapt) from InfluenzaB__AHL94053__NA
augcugcccaguaccauccagacccucacgcuguuccugaccuccggcggggugcuccugagccuguaccucuccgcccugcugagcuaccuccuguauuccgacauccugcucaaguucagcccgaccgagaucaccgcccccacgaugucccuggacugcgcgaacgccaguaacguccaggccgugaaccgcuccgccaccaagggcgugaccuuccugcuccccgagcccgaguggaccuacccgcggcugagcugucccggguccacguuccagcgcgcccugcucaucagcccccaccgguucggcgagaccaaggggaacuccgcgccccugaucauccgcgagccguucaucgccuguggccccaacgagugcaagcacuucgcccugacccacuaugccgcgcagcccggcggguacuacaacggcacccgcggggaccggaacaagcuccggcaccugaucagugucaagcugggcaagauccccacgguggagaacuccaucuuccacauggccgccuggagcggguccgccugccacgauggcaaggaguggaccuacaucggcguggacgggccggacaacgacgcccuccugaaggucaaguauggcgaggcguacaccgacaccuaccacagcuacgccaauaagauccugcgcacgcaggaguccgccugcaacugcaucgggggcaacugcuaucucaugaucaccgacggcagcgccagcgggguguccgagugccgguuccugaagauccgcgagggccggaucaucaaggagaucuuccccaccgggcgcgugaagcauaccgaggagugcacgugcggcuucgccagcaacaagaccaucgagugugcgugccgggacaacuccuacaccgccaagcgccccuucgucaagcugaacguggagaccgauacggccgagauccggcucaugugcaccgacaccuaccuggacacgccccgcccggacgacgggaguaucaccggccccugcgaguccaacggcgacaaggggagcggcgggaucaagggcggguucgugcaucagcggauggaguccaagaucggccgcugguacagccggaccauguccaagaccgagcgcaugggcauggggcuguacgucaaguacgacggcgaccccugggccgauagcgacgcccucgcguucuccggggugauggugagcaugaaggagcccggcugguacuccuuuggguucgagaucaaggacaagaagugcgacgucccgugcaucggcaucgagauggugcacgauggcgggaaggagaccuggcacagcgccgccacggccaucuacugccugaugggcuccgggcagcugcucugggacaccgugaccggcgucgacauggcccuguga

SEQ ID NO: 30294 - RNA, 1401 nt, Artificial Sequence; identical to SEQ ID NO: 29069
  derived and/or modified CDS sequence (AUadapt) from InfluenzaB__AHL94064__NA

SEQ ID NO: 30295 - RNA, 1401 nt, Artificial Sequence; identical to SEQ ID NO: 29069
  derived and/or modified CDS sequence (AUadapt) from InfluenzaB__AHL94075__NA

SEQ ID NO: 30296 - RNA, 1401 nt, Artificial Sequence
  derived and/or modified CDS sequence (AUadapt) from InfluenzaB__AHL94086__NA
augcugcccaguaccauccagacccucacgcuguuccugaccuccggcggggugcuccugagccuguacgucuccgccagccucuccuaccugcuguacagugacauccuccugaaguucucccgcaccgagaucaccgccccgaucaugccccuggacugcgcgaacgccucgaaugugcaggccgugaaccgguccgccacgaagggcgucaccuuccuccugcccgagcccgaguggaccuacccgcgccugagcugccccggguccaccuuccagaaggcccuccugaucaguccccaccgguucggcgagacgaaggggaacuccgcgccccugaucauccgcgagccguucguggccugcggccccaaggagugcaagcauuucgcccucacccacuacgccgcgcagcccggcggguacuacaacggcacccgggaggaucgcaacaagcugcggcaccugaucagcgugaagcucgggaagauccccaccgucgagaacuccaucuuccacauggccgccuggaguggcuccgccugccacgacgggcgcgaguggacguacaucggcguggacggcccggacaguaacgcccugcugaagaucaaguacggggaggcguacaccgacaccuaccacuccuaugccaagaacauccuccggacccaggagagcgccugcaacugcaucggcggggacuguuaccugaugaucacggacggccccgccagcggcaucuccgagugccgcuuccugaagauccgggaggggcgcaucaucaaggagaucuuccccaccggccgggugaagcauaccgaggagugcacgugcggguucgccagcaacaagaccaucgagugcgcgugucgcgacaacuccuacaccgccaagcggcccuucgucaagcucaacguggagaccgacaccgccgagauccgccugauguguacggagaccuaccuggacaccccgcggcccaacgacggcagcaucaccgggcccugcgaguccaauggcgacaagggcucggggggcaucaagggcggguucgugcaccagcgcauggccuccaagaucgggcggugguacagccgcacgauguccaagaccaagcggaugggcaugggccucuaugucaaguacgacggggaccccuggaccgacagcgaggcccuggcgcuguccggcgugauggugagcauggaggagccggggugguauuccuucggcuucgagaucaaggacaagaagugcgacguccccugcaucgggaucgagauggugcaugacggcggcaagaccacguggcacagcgccgccaccgccaucuacugccucaugggguccggccagcugcugugggacaccgugaccggggucaacaugacgcucuga

SEQ ID NO: 30297 - RNA, 1401 nt, Artificial Sequence; identical to SEQ ID NO: 29232
  derived and/or modified CDS sequence (AUadapt) from InfluenzaB__AHL94095__NA

SEQ ID NO: 30298 - RNA, 1401 nt, Artificial Sequence; identical to SEQ ID NO: 29069
  derived and/or modified CDS sequence (AUadapt) from InfluenzaB__AHL94106__NA

SEQ ID NO: 30299 - RNA, 1401 nt, Artificial Sequence
  derived and/or modified CDS sequence (AUadapt) from InfluenzaB__AHL94117__NA
augcugcccaguaccauccagaugcucacccuguuccugacguccggcggggugcuccugagccuguacgucuccgccucgcucuccuaccugcuguacagugacauccuccugaaguucuccccgaccgagaucaccgcccccaccaugccccuggacugcgcgaacgccagcaacgugcaugccgugaaccgcuccgccacgaagggcgucaccuuccuccugcccgagccggaguggaccuacccccggcugucgugccccggguccaccuuccagaaggcccuccugaucagcccccaucgcuucggcgagacgaaggggaacuccgcgccgcugaucauccgggagcccuucaucgccugcggccccaacgagugcaagcacuuugcccucacccacuacgccgcgcagcccggcggguacuacaacggcacccgcggggaccggaacaagcugcgccaucugaucagcgugaagcucggcaagaucccgaccguggagaacuccaucuuccacauggccgccuggucgggguccgccugccacgauggcaaggaguggacguacaucggcgucgacgggcccgacaacaacgcccugcugaagaucaaguacggcgaggcguacaccgauaccuaccacagcuacgccaacaacauccuccggacccaggaguccgccugcaauugcaucgggggcaacugcuaccugaugaucacggacggcucggccagcgggguguccgagugucgcuuccugaagauccgggagggccgcaucaucaaggagaucuuccccaccgggcgggugaagcacaccgaggagugcacgugcggcuucgccagcaauaagaccaucgagugcgcgugccgcgacaacuccuacaccgccaagcggcccuucgucaagcucaacguggagaccgauaccgccgagauccgccugaugugcacggacaccuaccuggacaccccgcggcccgacgacgggucgaucaccggccccugugaguccaacggcgacaaggggagcggcgggaucaagggcggguucgugcaccagcgcauggccuccaagaucggccggugguacagccgcacgauguccaagaccgagcggaagggcauggggcuccaugucaaguacgacggcgaccccuggaccgacucggacgcccuggcguuccgcggggugaugguguccaugaaggagccgggcugguauagcuucggguucgagaucaaggacaagaagugcgacguccccugcaucggcaucgagauggugcaugacggcgggaaggagaccuggcacuccgccgccacggccaucuacugccugaugggcagcgggcagcuccugugggacaccgugaccggcgucaacauggcccuguga

SEQ ID NO: 30300 - RNA, 1401 nt, Artificial Sequence; identical to SEQ ID NO: 29069
  derived and/or modified CDS sequence (AUadapt) from InfluenzaB__AHL94128__NA

SEQ ID NO: 30301 - RNA, 1401 nt, Artificial Sequence
  derived and/or modified CDS sequence (AUadapt) from InfluenzaB__AHL94139__NA
augcugcccaguaccauccagacccucacgcuguuccugaccuccggcggggugcuccugagccuguacgucuccgcccuccugagcuaccugcucuacuccgauauccugcugaaguucagcccgaccgagaucaccgcccccacgaugucccucgacugcgcgaacgccagcaaugugcaggccgugaaccgcuccgccaccaagggcgucaccuuccugcugcccgagcccgaguggaccuacccgcggcucagcugccccggguccacguuccagcgcgcccugcugaucucgccccaucgguucggcgagaccaaggggaacuccgcgccccucaucauccgcgagccguucaucgccugcggccccaacgagugcaagcauuucgcccugacccacuacgccgcgcagcccggcggguacuacaacggcacccgcggggaucggaacaagcugcggcaccucaucagcgugaagcugggcaagauccccacgguggagaacuccaucuuccacauggccgccuggagcggguccgccugucacgacggcaaggaguggaccuacaucggcgucgacgggccggacaacgaugcccugcucaaggugaaguacggcgaggcguacaccgacaccuaccacagcuaugccaacaagauccugcgcacgcaggaguccgccugcaacugcaucgggggcaacugcuaccugaugaucaccgauggcagcgccagcgggguguccgagugccgguuccucaagauccgcgagggccggaucaucaaggagaucuuccccaccgggcgcgucaagcacaccgaggaguguacgugcggcuucgccucgaacaagaccaucgagugcgcgugccgggauaacuccuacaccgccaagcgccccuucgugaagcugaacguggagaccgacacggccgagaucaagcugaugugcaccgacaccuaucucgacacgccccggccggacgacgggagcaucaccggccccugcgaguccaacggcgauaaggggagcggcgggaucaagggcggguucguccaccagcgcauggaguccaagaucggccggugguacagccgcaccauguccaagaccgagcggaugggcauggggcuguacgugaaguaugacggcgaccccugggccgacagcgacgcccuggcguucuccggggugauggucagcaugaaggagcccggcugguauuccuucggguucgagaucaaggacaagaagugcgacgugccgugcaucggcaucgagauggugcaugacggcgggaaggagaccuggcacagcgccgccacggccaucuacugccucaugggcuccgggcagcugcugugggacaccgucaccggcguggacauggcccucuga

SEQ ID NO: 30302 - RNA, 1401 nt, Artificial Sequence; identical to SEQ ID NO: 30259
  derived and/or modified CDS sequence (AUadapt) from InfluenzaB__AHL94150__NA

SEQ ID NO: 30303 - RNA, 1401 nt, Artificial Sequence
  derived and/or modified CDS sequence (AUadapt) from InfluenzaB__AHL94161__NA
augcugcccaguaccauccagaugcucacccuguuccugacguccggcggggugcuccugagccuguacgucuccgccucgcucuccuaccugcuguacagcgauauccuccugaaguucuccccgaccgagaucaccgcccccaccaugccccuggacugcgcgaacgccagcaacgugcacgccgugaaucgcuccgccacgaagggcgucaccuuccuccugcccgagccggaguggaccuacccccggcugucgugccccggguccaccuuccagaaggcccuccugaucagcccccaccgcuucggcgagacgaaggggaauuccgcgccgcugaucauccgggagcccuucaucgccugcggccccaacgagugcaagcacuucgcccucacccacuaugccgcgcagcccggcggguacuacaacggcacccgcggggaccggaacaagcugcgccaccugaucagcgugaagcucggcaagaucccgaccguggagaacuccaucuuucacauggccgccuggucgggguccgccugccacgacggcaaggaguggacguacaucggcgucgacgggcccgauaacaacgcccugcugaagaucaaguacggcgaggcguacaccgacaccuaccacagcuaugccaacaacauccuccggacccaggaguccgccugcaacugcaucgggggcaacugcuaucugaugaucacggacggcucggccagcgggguguccgagugccgcuuccugaagauccgggagggccgcaucaucaaggagaucuuccccaccgggcgggugaagcacaccgaggagugcacguguggcuucgccagcaacaagaccaucgagugcgcgugccgcgacaacuccuauaccgccaagcggcccuucgucaagcucaacguggagaccgacaccgccaagauccgccugaugugcacggacaccuaccuggacaccccgcggcccgacgaugggucgaucaccggccccugcgaguccaacggcgacaaggggagcggcgggaucaagggcggguucgugcaccagcgcauggccuccaagaucggccggugguauagccgcacgauguccaagaccgagcggaagggcauggggcucuacgucaaguacgacggcgaccccuggaccgacucggacgcccuggcguuucgcggggugaugguguccaugaaggagccgggcugguacagcuucggguucgagaucaaggacaagaagugcgacguccccuguaucggcaucgagauggugcacgacggcgggaaggagaccuggcacuccgccgccacggccaucuacugccugaugggcagcgggcagcuccugugggacaccgugaccggcgucgacauggcccuguga

SEQ ID NO: 30304 - RNA, 1401 nt, Artificial Sequence; identical to SEQ ID NO: 30259
  derived and/or modified CDS sequence (AUadapt) from InfluenzaB__AHL94183__NA

SEQ ID NO: 30305 - RNA, 1404 nt, Artificial Sequence
  derived and/or modified CDS sequence (AUadapt) from InfluenzaB__AHL94194__NA
augcugcccaguaccauccagacccucacgcuguuccugaccuccggcggggugcuccugagccuguacgucuccgcccuccugagcuaccugcucuauuccgacauccugcugaaguucagcccgaccgagaucaccgcccccacgaugucccucgacugcgcgaacgccaguaacgugcaggccgugaaccgcuccgccaccaagggcgucaccuuccugcugcuccccgagcccgaguggaccuacccgcggcugagcugccccggguccacguuucagcgcgcccugcucaucagcccccaccgguucggcgagaccaaggggaacuccgcgccccugaucauccgcgagccguucaucgccugcggccccaaugagugcaagcacuucgcccugacccacuacgccgcgcagcccggcggguacuauaacggcacccgcggggaccggaacaagcuccggcaccugaucagcgugaagcugggcaagauccccacgguggagaacuccaucuuucacauggccgccuggagcggguccgccugccacgacggcaaggaguggaccuacaucggcgucgaugggccggacaacgacgcccuccugaaggugaaguacggcgaggcguacaccgacaccuaucacagcuacgccaacaagauccugcgcacgcaggaguccgccugcaacuguaucgggggcaacugcuaccucaugaucaccgacggcagcgccagcgggguguccgagugucgguuccugaagauccgcgagggccggaucaucaaggagaucuuccccaccgggcgcgucaagcacaccgaggagugcacgugcggcuucgccaguaacaagaccaucgagugcgcgugccgggacaacuccuacaccgccaagcgccccuuugugaagcugaacguggagaccgacacggccgagauccggcucaugugcaccgacaccuaccuggacacgccccgcccggaugacgggagcaucaccggccccugcgaguccaacggcgacaaggggagcggcgggaucaagggcggguuuguccaccagcggauggaguccaagaucggccgcugguacagccggaccauguccaagaccgagcgcaugggcauggggcuguacgugaaguacgacggcgaucccugggccgacagcgacgcccucgcguucuccggggugauggucagcaugaaggagcccggcugguacuccuuuggguucgagaucaaggacaagaagugcgacgugccgugcaucggcaucgagauggugcacgauggcgggaaggagaccuggcacagcgccgccacggccaucuacugccugaugggcuccgggcagcugcucugggacaccgucaccggcguggacauggcccuguga

SEQ ID NO: 30306 - RNA, 1401 nt, Artificial Sequence; identical to SEQ ID NO: 29069
  derived and/or modified CDS sequence (AUadapt) from InfluenzaB__AHL94205__NA

SEQ ID NO: 30307 - RNA, 1401 nt, Artificial Sequence; identical to SEQ ID NO: 29232
  derived and/or modified CDS sequence (AUadapt) from InfluenzaB__AHL94214__NA

SEQ ID NO: 30308 - RNA, 1401 nt, Artificial Sequence
  derived and/or modified CDS sequence (AUadapt) from InfluenzaB__AHL94224__NA
augcugcccaguaccauccagaugcucacccuguuccugacguccggcggggugcuccugagccuguacgucuccgccagccucuccuaccugcuguacucggauauccuccugaaguucuccccgaccgagaucaccgcccccaccaugccccuggacugcgcgaacgccagcaacgugcacgccgugaaucgcuccgccacgaagggcgucaccuuccuccugcccgagccggaguggaccuacccccggcugagcugccccggguccaccuuccagaaggcccuccugaucucgccccaccgcuucggcgagacgaaggggaauuccgcgccgcugaucauccgggagcccuucaucgccugcggccccaacgagugcaagcacuucgcccucacccacuaugccgcgcagcccggcggguacuacaacggcacccgcggggaccggaacaagcugcgccaccugaucagcgugaagcucggcaagaucccgaccguggagaacuccaucuuucacauggccgccuggagcggguccgccugccacgacggcaaggaguggacguacaucggcgucgacgggcccgauaacaacgcccugcugaagaucaaguacggcgaggcguacaccgacaccuaccacucguaugccaacaacauccuccggacccaggaguccgccugcaacugcaucgggggcaacugcuaucugaugaucacggacggcagcgccagcgggguguccgagugccgcuuccugaagauccgggagggccgcaucaucaaggagaucuuccccaccgggcgggugaagcacaccgaggagugcacguguggcuucgccucgaacaagaccaucgagugcgcgugccgcgacaacuccuauaccgccaagcggcccuucgucaagcucaacguggagaccgacaccgccgagauccgccugaugugcacggacaccuaccuggacaccccgcggcccgacgaugggagcaucaccggccccugcgaguccaacggcgacaaggggagcggcgggaucaagggcggguucgugcaccagcgcauggccuccaagaucggccggugguauucgcgcacgauguccaagaccgagcggaagggcauggggcucuacgucaaguacgacggcgaccccuggaucgacagcgacgcccuggcguuucgcggggugaugguguccaugaaggagccgggcugguacagcuucggguucgagaucaaggacaagaagugcgacguccccuguaucggcaucgagauggugcacgacggcgggaaggagaccuggcacuccgccgccaccgccaucuacugccugaugggcagcgggcagcuccugugggacacggugaccggcgucgacauggcccuguga

SEQ ID NO: 30309 - RNA, 1401 nt, Artificial Sequence; identical to SEQ ID NO: 29069
  derived and/or modified CDS sequence (AUadapt) from InfluenzaB__AHL94235__NA

SEQ ID NO: 30310 - RNA, 1401 nt, Artificial Sequence; identical to SEQ ID NO: 29232
  derived and/or modified CDS sequence (AUadapt) from InfluenzaB__AHL94246__NA

SEQ ID NO: 30311 - RNA, 1401 nt, Artificial Sequence; identical to SEQ ID NO: 29232
  derived and/or modified CDS sequence (AUadapt) from InfluenzaB__AHL94257__NA

SEQ ID NO: 30312 - RNA, 1401 nt, Artificial Sequence; identical to SEQ ID NO: 28686
  derived and/or modified CDS sequence (AUadapt) from InfluenzaB__AHL94267__NA

SEQ ID NO: 30313 - RNA, 1401 nt, Artificial Sequence; identical to SEQ ID NO: 28686
  derived and/or modified CDS sequence (AUadapt) from InfluenzaB__AHL94278__NA

SEQ ID NO: 30314 - RNA, 1401 nt, Artificial Sequence; identical to SEQ ID NO: 28686
  derived and/or modified CDS sequence (AUadapt) from InfluenzaB__AHL94299__NA

SEQ ID NO: 30315 - RNA, 1401 nt, Artificial Sequence
  derived and/or modified CDS sequence (AUadapt) from InfluenzaB__AHL94310__NA
augcugcccaguaccauccagacccucacgcuguuccugaccuccggcggggugcuccugagccuguacgucuccgccagccucuccuaccugcuguauagcgacauccuccugaaguucucccgcaccgagaucaccgccccgaucaugccccuggacugcgcgaaugccagcaacgugcaggccgugaaccgguccgccacgaagggcgucacgccccuccugcccgagccggaguggaccuacccccgccugucgugucccggguccaccuuccagaaggcccuccugaucagcccccaccgguucggcgagaccaaggggaacuccgcgccgcugaucauccgcgagcccuucaucgccuguggccccaaggagugcaagcacuucgcccucacccacuacgccgcgcagcccggcggguauuacaacggcacccgggaggaccgcaacaagcugcggcaccugaucagugugaagcucgggaagaucccgaccguggagaacuccaucuuccacauggccgccuggagcggcuccgccugccacgaugggcgcgaguggacguacaucggcgucgacggccccgacagcaacgcccugcugaagaucaaguauggggaggcguacaccgacaccuaccacuccuacgccaagaauauccuccggacccaggagucggccugcaacugcaucggcggggacugcuaucugaugaucacggacggcagcgccuccggcaucagcgagugccgcuuccugaagauccgggaggggcgcaucaucaaggagaucuuucccaccggccgggugaagcacaccgaggagugcacgugcggguucgccuccaacaagaccaucgagugugcgugccgcgacaacagcuacaccgccaagcggcccuucgugaagcucaaugucgagaccgacaccgccgagauccgccugaugugcacggagaccuaccuggacaccccgcggcccaacgauggcuccaucgccgggcccugcgagagcaacggcgacgagggcuccgggggcaucaagggcggguucgugcaucagcgcauggccucgaagaucgggcggugguacucccgcaccaugagcaagacgaagcggaugggcaugggccucuacgugaaguacgacggggaucccuggaccgacuccgaggcgcuggcccugagcggcgucaugguguccauggaggagccggggugguacagcuucggcuuugagaucaaggacaagaagugcgacgugcccugcaucgggaucgagaugguccacgauggcggcaagaccaccuggcacuccgccgccacggccaucuacugccucauggggagcggccagcugcugugggacaccgugaccggggugaacaugacccucuga

SEQ ID NO: 30316 - RNA, 1401 nt, Artificial Sequence; identical to SEQ ID NO: 30315
  derived and/or modified CDS sequence (AUadapt) from InfluenzaB__AHL94321__NA

SEQ ID NO: 30317 - RNA, 1401 nt, Artificial Sequence
  derived and/or modified CDS sequence (AUadapt) from InfluenzaB__AHL94332__NA
augcugcccaguaccauccagacccucacgcuguuccugaccuccggcggggugcuccugagccuguacgucuccgccagccucuccuaccugcuguauagcgacauccuccugaaguucucccgcaccgagaucaccgccccgaucaugccccuggacugcgcgaaugccucgaacgugcaggccgugaaccgguccgccacgaagggcgucacgccccuccugcccgagccggaguggaccuacccccgccugagcugucccggguccaccuuccagaaggcccuccugaucagcccccaccgguucggcgagaccaaggggaacuccgcgccgcugaucauccgcgagcccuucaucgccuguggccccaaggagugcaagcacuucgcccucacccacuacgccgcgcagcccggcggguauuacaacggcacccgggaggaccgcaacaagcugcggcaccugaucagugugaagcucgggaagaucccgaccguggagaacuccaucuuccacauggccgccuggagcggcuccgccugccaugacgggcgcgaguggacguacaucggcgucgacggccccgacucgaacgcccugcugaagaucaaguauggggaggcguacaccgacaccuaccacuccuacgccaagaauauccuccggacccaggagagcgccugcaacugcaucggcggggacuguuaccugaugaucacggacggccccgccagcggcaucuccgagugccgcuuccugaagauccgggaggggcgcaucaucaaggagaucuuucccaccggccgggugaagcacaccgaggagugcacgugcggguucgccagcaacaagaccaucgagugugcgugccgcgacaacuccuacaccgccaagcggccguucgugaagcucaaugucgagaccgacaccgccgagauccgccugaugugcacggagaccuaccuggacacgccccggcccaacgauggcagcaucaccgggcccugcgaguccaacggcgacgagggcucggggggcaucaagggcggguuugugcaccagcgcauggccuccaagaucgggcggugguacagccgcaccauguccaagaccaagcggaugggcaugggccucuacgugaaguacgacggggauccguggaccgacagcgaggcccuggcgcuguccggcgucauggugagcauggaggagcccgggugguacuccuucggcuuugagaucaaggacaagaagugcgacgugcccugcaucgggaucgagaugguccacgauggcggcaagaccacguggcacagcgccgccaccgccaucuacugccucaugggguccggccagcugcugugggacaccgugaccggggugaacaugacgcucuga

SEQ ID NO: 30318 - RNA, 1401 nt, Artificial Sequence; identical to SEQ ID NO: 28686
  derived and/or modified CDS sequence (AUadapt) from InfluenzaB__AHL94343__NA

SEQ ID NO: 30319 - RNA, 1401 nt, Artificial Sequence; identical to SEQ ID NO: 28678
  derived and/or modified CDS sequence (AUadapt) from InfluenzaB__AHL94354__NA

SEQ ID NO: 30320 - RNA, 1401 nt, Artificial Sequence; identical to SEQ ID NO: 28678
  derived and/or modified CDS sequence (AUadapt) from InfluenzaB__AHL94365__NA

SEQ ID NO: 30321 - RNA, 1401 nt, Artificial Sequence
  derived and/or modified CDS sequence (AUadapt) from InfluenzaB__AHL94387__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccagcaccgugcaggccgugaaccgcuccgccaccaagggcgucacccuccugcugcccgagccggaguggacguacccccggcucagcugccccggguccaccuuccagaaggcccugcugaucaguccccaccgcuucggcgagaccaaggggaacuccgcgccgcucaucauccgggagcccuucaucgccugcggccccaaugagugcaagcacuucgcccugacccacuacgccgcgcagcccggcggguacuauaacggcacgcgcggggaccggaacaagcugcgccaccucaucagcgugaagcugggcaagaucccgaccguggagaauuccaucuuccacauggccgccuggagcggguccgccugccacgacggcaaggaguggaccuaucugggcgucgacgggcccgacaacaacgcccuccugaaggugaaguacggcgaggcguauaccgacacguaccacagcuacgccaacaagauccugcggacccaggaguccgccuguaacugcaucgggggcaacugcuaccucaugaucaccgauggcagcgccagcgggguguccgagugccgcuuccugaagauccgggagggccgcaucaucaaggagaucuuccccaccgggcgggucaagcacacggaggaguguacgugcggcuucgccucgaacaagaccaucgagugcgcgugucgcgacaaccgguacaccgccaagcgccccuucgugaagcugaacguggagaccgacaccgccgagauccggcucauguguaccgacaccuaccuggacacgccgcgccccaacgacggguccaucaccggccccugugagagcgacggcgacaagggguccggcgggaucaagggcggguucguccaccagcggaugaaguccaagaucggccgcugguacagucggaccaugagcaagaccgagcgcaugggcauggggcuguacgugaaguacgacggcgaccccugggccgauuccgacgcccucgcguucagcggggugauggucuccaugaaggagccgggcugguacagcuucggguuugagaucaaggacaagaagugcgacgugcccugcaucggcaucgagauggugcacgauggcgggaaggagaucuggcacuccgccgccacggccaucuacugccugaugggcagcgggcagcugcucugggacaccgucaccggcguggacauggcccuguga

SEQ ID NO: 30322 - RNA, 1404 nt, Artificial Sequence
  derived and/or modified CDS sequence (AUadapt) from InfluenzaB__AHL94398__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccgcuccgccaccaagggcgucacccuccugcugcuccccgagccggaguggaccuacccccggcugagcugccccggguccacguuccagaaggcccugcucaucagcccccaucgcuucggcgagaccaaggggaacuccgcgccgcugaucauccgggagcccuucaucgccugcggccccaacgagugcaagcacuuugcccugacccacuacgccgcgcagcccggcggguacuacaacggcacccgcggggaccggaauaagcuccgccaccugaucucggugaagcugggcaagaucccgacgguggagaacuccaucuuccacauggccgccuggagcggguccgccugucacgacggcaaggaguggaccuacaucggcgucgacgggcccgacaacaacgcccuccugaaggugaaguauggcgaggcguacaccgacaccuaccacagcuacgccaauaagauccugcggacgcaggaguccgccugcaacugcaucgggggcaacugcuaccucaugaucaccgauggcagcgccucggggguguccgagugccgcuuccugaagauccgggagggccgcaucaucaaggagaucuuccccaccgggcgggucaagcacaccgaggaguguacgugcggcuucgccagcaacaagaccaucgagugcgcgugccgcgacaaucgguacaccgccaagcgccccuucgugaagcugaacguggagaccgacacggccgagauccggcucaugugcaccgacaccuaucuggacaccccgcgccccaacgacggguccaucacgggccccugcgagagcgacggcgauaagggguccggcgggaucaagggcggguucguccaccagcggaugaaguccaagaucggccgcugguacagccggaccaugucgaagaccgagcgcaugggcauggggcuguacgugaaguacgauggcgaccccugggccgacuccgacgcccucgcguucagcggggugauggucuccaugaaggagccgggcugguacaguuucggguucgagaucaaggacaagaagugcgacgugcccugcaucggcaucgagauggugcaugacggcgggaaggagaccuggcacuccgccgccacggccaucuacugccugaugggcagcgggcagcugcucugggacaccgucaccggcguggacauggcccuguga

SEQ ID NO: 30323 - RNA, 1401 nt, Artificial Sequence; identical to SEQ ID NO: 28678
  derived and/or modified CDS sequence (AUadapt) from InfluenzaB__AHL94409__NA

SEQ ID NO: 30324 - RNA, 1401 nt, Artificial Sequence
  derived and/or modified CDS sequence (AUadapt) from InfluenzaB__AHL94431__NA
augcugcccaguaccauccagacccucacgcuguuccugaccuccggcggggugcuccugagccuguacgucuccgccagccucuccuaccugcuguacagugacauccuccugaaguucucccagaccgagaucaccgccccgaucaugccccuggacugcgcgaacgccagcaaugugcaggccgugaaccacuccgccgccaagggcgucacgcucauccugcccgagcccgaguggaccuacccgcgccugagcugccccggguccaccuuccagaaggcgcuccugaucaguccccaccgguucggcgagaucaaggggaacuccgcgccccugaucauccgcgagccguucaucgccugcggccccaccgagugcaagcauuucgcccucacgcacuacgccgcccagcccggcggguacuacaacggcacccgggaggaucgcaacaagcugcggcaccugaucucggugaagcucgggaagauccccaccguggagaacuccaucuuccacauggccgccuggaguggcuccgccugccacgacgggaaggaguggaccuacaucggcgucgacggcccggacaguaacgcgcugcugaagaucaaguacggggaggccuacacggacaccuaccacuccuaugccaagaacauccuccgcacccaggagagcgccugcaacugcaucggcggggacuguuaccugaugaucaccgacggccccgccucgggcguguccgagugccgguuccugaagauccgcgaggggcggaucaucaaggagaucuuccccacgggccgcgugaagcauaccgaggagugcacgugcggguucgcgagcaacaagaccaucgagugcgccugucgggacaaccgcuacaccgccaagcggcccuucgucaagcucaacguggagaccgacaccgccgagauccgccugauguguaccgagacguaccuggacaccccgcggcccaacgacggcuccaucaccgggcccugcgagagcgauggcgacaagggcuccgggggcaucaagggcggguucgugcaccagcgcauggccagcaagaucgggcggugguacucccgcaccaugucgaagacgaagcggaugggcaugggccucuaugucaaguacgacggggaccccuggaccgacuccgaggcgcuggcccugagcggcgugaugaucuccauggaggagccggggugguacaguuucggcuucgagaucaaggacaagaagugcgacgugcccugcaucgggaucgagaugguccaugacggcggcaagaccaccuggcacuccgccgccacggccaucuacugccucauggggagcggccagcugcugugggacaccgugaccgggguggacauggcgcucuga

SEQ ID NO: 30325 - RNA, 1401 nt, Artificial Sequence
  derived and/or modified CDS sequence (AUadapt) from InfluenzaB__AHL94442__NA
augcugcccaguaccauccagacccucacgcuguuccugaccuccggcggggugcuccugagccuguacauguccgccagccucuccuaccugcuguauagcgacauccuccugaaguucucccgcaccgagaucaccgccccgaucaugccccuggacugcgcgaacgccaguaacguccaggccgugaaccgguccgccacgaagggcgugacgccccuccugcccgagccggaguggaccuacccccgccugagcugccccggguccaccuuccagaaggcccuccugaucaguccccaccgguucggcgagaccaaggggaacuccgcgccgcugaucauccgcgagcccuucaucgccugcggccccaaggaguguaagcacuucgcccucacccacuacgccgcgcagcccggcggguacuacaauggcacccgggaggaccgcaacaagcugcggcaccugaucagcgucaagcucgggaagaucccgaccguggagaacuccaucuuccauauggccgccuggucgggcuccgccugccacgacgggcgcgaguggacguacaucggcguggauggccccgacagcaacgcccugcugaagaucaaguacggggaggcguacaccgacaccuaucacuccuacgccaagaacauccuccggacccaggagagcgccugcaacuguaucggcggggacugcuaccugaugaucacggacggcagcgccuccggcaucagugagugccgcuuccugaagauccgggaggggcgcaucaucaaggagaucuuccccaccggccgggucaagcacaccgaggagugcacgugcggguuugccuccaacaagaccaucgagugcgcgugccgcgacaacagcuauaccgccaagcggcccuucgugaagcucaacguggagaccgacaccgccgagauccgccugaugugcacggagaccuaccuggauaccccgcggcccaacgacggcuccaucgccgggcccugcgagagcaacggcgacgagggcuccgggggcaucaagggcggguuuguccaccagcgcauggccagcaagaucgggcggugguacucccgcaccaugucgaagacgaagcggaugggcaugggccucuacgugaaguacgauggggaccccuggaccgacuccgaggcgcuggcccugagcggcgugauggucuccauggaggagccggggugguacagcuuuggcuucgagaucaaggacaagaagugcgacgugcccugcaucgggaucgagauggugcacgauggcggcaagaccaccuggcacuccgccgccacggccaucuacugccucauggggagcggccagcugcugugggacaccgucaccggggugaacaugacccucuga

SEQ ID NO: 30326 - RNA, 1401 nt, Artificial Sequence; identical to SEQ ID NO: 30315
  derived and/or modified CDS sequence (AUadapt) from InfluenzaB__AHL94464__NA

SEQ ID NO: 30327 - RNA, 1401 nt, Artificial Sequence; identical to SEQ ID NO: 28686
  derived and/or modified CDS sequence (AUadapt) from InfluenzaB__AHL94475__NA

SEQ ID NO: 30328 - RNA, 1401 nt, Artificial Sequence; identical to SEQ ID NO: 28678
  derived and/or modified CDS sequence (AUadapt) from InfluenzaB__AHL94486__NA

SEQ ID NO: 30329 - RNA, 1401 nt, Artificial Sequence; identical to SEQ ID NO: 28686
  derived and/or modified CDS sequence (AUadapt) from InfluenzaB__AHL94497__NA

SEQ ID NO: 30330 - RNA, 1401 nt, Artificial Sequence; identical to SEQ ID NO: 30315
  derived and/or modified CDS sequence (AUadapt) from InfluenzaB__AHL94508__NA

SEQ ID NO: 30331 - RNA, 1401 nt, Artificial Sequence
  derived and/or modified CDS sequence (AUadapt) from InfluenzaB__AHL94519__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccgcuccgccaccaagggcgucacccuccugcugcccgagccggaguggaccuacccccggcucagcugccccggguccacguuccagaaggcccugcugaucagcccccaucgcuucggcgagaccaaggggaacuccgcgccgcucaucauccgggagcccuucaucgccugcggccccaacgagugcaagcacuuugcccugacccacuacgccgcgcagcccggcggguacuacaacggcacccgcggggaccggaauaagcugcgccaccucaucucggugaagcugggcaagaucccgacgguggagaacuccaucuuccacauggccgccuggagcggguccgccugucacgacggcaaggaguggaccuacaucggcgucgacgggcccgacaacaacgcccugcucaaggugaaguauggcgaggcguacaccgacaccuaccacagcuacgccaauaagauccugcggacgcaggaguccgccugcaacugcaucgggggcaacugcuaccugaugaucaccgauggcagcgccucggggguguccgagugccgcuuccucaagauccgggagggccgcaucaucaaggagaucuuccccaccgggcgggucaagcacaccgaggaguguacgugcggcuucgccagcaacaagaccaucgagugcgcgugccgcgacaauuccuacaccgccaagcggcccuucgugaagcugaacguggagaccgacacggccgagauccgccugaugugcaccgacaccuaucucgacaccccgcggcccaacgacgggagcaucacgggccccugcgaguccgacggcgauaaggggagcggcgggaucaagggcggguucguccaccagcgcauggaguccaagaucggccggugguacucgcgcaccauguccaagaccgagcggaugggcauggggcuguacgugaaguacgauggcgaccccuggaccgacagcgacgcccuggccuucuccggggugauggucagcaugaaggagccgggcugguauuccuucggguucgagaucaaggacaagaagugcgacgugcccugcaucggcaucgagauggugcaugacggcgggaaggagacguggcacagcgcggccaccgccaucuacugccucaugggcuccgggcagcugcugugggacaccgucaccggcguggacauggcccucuga

SEQ ID NO: 30332 - RNA, 1401 nt, Artificial Sequence; identical to SEQ ID NO: 30315
  derived and/or modified CDS sequence (AUadapt) from InfluenzaB__AHL94530__NA

SEQ ID NO: 30333 - RNA, 1401 nt, Artificial Sequence; identical to SEQ ID NO: 28678
  derived and/or modified CDS sequence (AUadapt) from InfluenzaB__AHL94541__NA

SEQ ID NO: 30334 - RNA, 1401 nt, Artificial Sequence
  derived and/or modified CDS sequence (AUadapt) from InfluenzaB__AHL94563__NA
augcugcccaguaccauccagacccucacgcuguuccugacccucggcggggugcugcugucccucuacgucagcgccucccugagcuaccugcucuacuccgauauccugcugaaguucucgcgcaccgagaucaccgccccgaucaugccccucgacugcgcgaacgccuccaacgugcaggccgugaaucggagcgccacgaagggcgucacccugcugcuccccgagcccgaguggaccuacccgcgccuguccugccccgggagcaccuuccagaaggcccugcucaucagcccccaucgguucggcgagacgaaggggaacuccgcgccccugaucauccgcgagccguucaucgccugcggccccaaggagugcaagcacuuugcccugacccacuacgccgcgcagcccggcggguacuacaacggcacccgggaggaccgcaauaagcuccggcaccugaucuccgugaagcuggggaagauccccaccguggagaacucgaucuuccacauggccgccugguccggcagcgccugucacgacgggcgcgaguggacguacaucggcgucgacggcccggacuccaacgcccuccugaagaucaaguauggggaggcguacaccgacaccuaccacagcuacgccaagaauauccugcggacccaggaguccgccugcaacugcaucggcggggacugcuaccucaugaucacggauggccccgccagcggcaucucggagugccgcuuccugaagauccgggaggggcgcaucaucaaggagaucuuccccaccggccgggugaagcacaccgaggaguguacgugcggguucgccuccaacaagaccaucgagugcgcgugccgcgacaauagcuacaccgccaagcggcccuucgugaagcugaacgucgagaccgacaccgccgagauccgccucaugugcacggagaccuaucuggacaccccgcggcccaacgacggcuccaucaccgggcccugcgagagcaacggcgauaagggcuccgggggcaucaagggcggguucgugcaccagcgcauggccagcaagaucgggcggugguacucccgcacgaugucgaagaccaagcggaugggcaugggccuguacgugaaguaugacggggaccccuggaccgacuccgaggcccucgcgcugagcggcgucaugguguccauggaggagccggggugguacagcuuuggcuucgagaucaaggacaagaagugcgacgugcccugcaucgggaucgagaugguccacgauggcggcaagaccacguggcacuccgccgccaccgccaucuacugccugauggggagcggccagcuccugugggacaccgugaccggggugaacaugacgcuguga

SEQ ID NO: 30335 - RNA, 1401 nt, Artificial Sequence; identical to SEQ ID NO: 28675
  derived and/or modified CDS sequence (AUadapt) from InfluenzaB__AHL94574__NA

SEQ ID NO: 30336 - RNA, 1401 nt, Artificial Sequence
  derived and/or modified CDS sequence (AUadapt) from InfluenzaB__AHL94585__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaaugccagcaacgugcaggccgugaaccgcuccgccgccaagggcgucacgcuccugcugcccgagcccgaguggaccuacccgcggcucagcugucccggguccaccuuccagaaggcgcugcugaucucgccccaccgcuucggcgagaucaaggggaacuccgcgccccucaucauccgggagccguucaucgccuguggccccaccgagugcaagcacuucgcccugacgcacuacgccgcccagcccggcggguauuacaacggcacccgcgaggaccggaacaagcugcgccaccucaucagugugaagcuggggaagauccccaccguggagaacuccaucuuccacauggccgccuggagcggcuccgccugccaugacgggaaggaguggaccuacaucggcgucgacggcccggacagcaacgcgcugcucaagaucaaguauggggaggccuacacggacaccuaccacuccuacgccaagaauauccugcggacccaggagagcgccugcaacugcaucggcggggacuguuaccugaugaucaccgacggccccgccagcggcguguccgagugccgcuuccucaagauccgggaggggcgcaucaucaaggagaucuuucccaagggccgggugaagcacacggaggagugcacgugcggguucgcgucgaacaagaccaucgagugugccugccgcgacaaccgguacaccgccaagcgccccuucgucaagcugaauguggagaccgacaccgccgagauccggcugaugugcaccgagaccuaccucgacacgccgcgccccaacgauggcuccaucaccgggcccugcgagagcgacggcgacaagggcuccgggggcaucaagggcggguucgugcaucagcggauggccagcaagaucgggcgcugguacucccggaccaugagcaagaccaagcgcaugggcaugggccuguacgucaaguacgacggggaucccuggacggacuccgaggcgcuggcccucagcggcgugaugguguccauggaggagccggggugguacagcuucggcuuugagaucaaggacaagaagugcgacguccccugcaucgggaucgagauggugcacgauggcggcaagaccaccuggcacuccgccgccaccgccaucuacugccugauggggagcggccagcugcucugggacacggugaccggggucgacauggcgcuguga

SEQ ID NO: 30337 - RNA, 1401 nt, Artificial Sequence; identical to SEQ ID NO: 28675
  derived and/or modified CDS sequence (AUadapt) from InfluenzaB__AHL94596__NA

SEQ ID NO: 30338 - RNA, 1401 nt, Artificial Sequence
  derived and/or modified CDS sequence (AUadapt) from InfluenzaB__AHL94607__NA
augcugcccaguaccauccagacccucacgcuguuccugaccuccggcggggugcuccugagccuguacgucuccgccagccucuccuaccugcuguauucggacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuccagaaggcccugcugaucaguccccaccgcuucggcgagaccaaggggaacuccgcgccgcucaucauccgggagcccuucaucgccugcggccccaacgaguguaagcacuucgcccugacccacuacgccgcgcagcccggcggguacuacaauggcacccgcggggaccggaacaagcugcgccaccucaucucggugaagcugggcaagaucccgacgguggagaacuccaucuuccauauggccgccuggagcggguccgccugccacgacggcaaggaguggaccuacaucggcgucgacgggcccgauaacaacgcccugcucaaggugaaguacggcgaggcguacaccgacaccuaccauagcuacgccaacaagauccugcggacgcaggaguccgccugcaacugcaucgggggcaauugcuaccugaugaucaccgacggcagcgccucggggguguccgagugucgcuuccucaagauccgggagggccgcaucaucaaggagaucuuccccaccgggcgggucaagcacaccgaggagugcacgugcggcuucgccaguaacaagaccaucgagugcgcgugccgcgacaaccgguacaccgccaagcgccccuuugugaagcugaacguggagaccgacacggccgagauccggcugaugugcaccgacaccuaccucgacaccccgcgccccaaugacggguccaucacgggccccugcgagagcgacggcgacaagggguccggcgggaucaagggcggguucguccaucagcggcucaagagcaagaucggccgcugguacucccggaccaugucgaagaccgagcgcaugggcauggggcuguacgugaaguacgacggcgaucccugggccgacuccgacgcccugaccuucagcggggugauggucuccaugaaggagccgggcugguacagcuuuggguucgagaucaaggacaagaagugcgacgugcccugcaucggcaucgagauggugcacgauggcgggaaggagacguggcacuccgcggccaccgccaucuacugccugaugggcagcgggcagcugcucugggacaccgucaccggcguggacauggcccuguga

SEQ ID NO: 30339 - RNA, 1401 nt, Artificial Sequence; identical to SEQ ID NO: 28678
  derived and/or modified CDS sequence (AUadapt) from InfluenzaB__AHL94618__NA

SEQ ID NO: 30340 - RNA, 1401 nt, Artificial Sequence; identical to SEQ ID NO: 30315
  derived and/or modified CDS sequence (AUadapt) from InfluenzaB__AHL94628__NA

SEQ ID NO: 30341 - RNA, 1401 nt, Artificial Sequence; identical to SEQ ID NO: 28678
  derived and/or modified CDS sequence (AUadapt) from InfluenzaB__AHL94639__NA

SEQ ID NO: 30342 - RNA, 1401 nt, Artificial Sequence
  derived and/or modified CDS sequence (AUadapt) from InfluenzaB__AHL94650__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccagcaacgugcaggccgugaaccgcuccgccaccaagggcgucacccuccugcugcccgagccggaguggaccuacccccggcucagcugucccggguccacguuccagaaggcccugcugaucucgccccaccgcuucggcgagaccaaggggaacuccgcgccgcucaucauccgggagcccuuuaucgccugcggccccaacgagugcaagcacuucgcccugacccacuaugccgcgcagcccggcggguacuacaacggcacccgcggggaccggaacaagcugcgccaucucaucagcgugaagcugggcaagaucccgacgguggagaacuccaucuuccacauggccgccuggagcggguccgccugucacgacggcaaggaguggaccuacaucggcgucgacgggcccgacaauaacgcccugcucaaggugaaguacggcgaggcguacaccgacaccuaccauagcuacgccaacaagauccugcggacgcaggaguccgccugcaacugcaucgggggcaauugcuaccugaugaucaccgacggcagcgccagcgggguguccgagugucgcuuccucaagauccgggagggccgcaucauccgggagaucuuccccaccgggcgcgucaagcacaccgaggagugcacgugcggcuuugccucgaacaagaccaucgagugcgcgugccgggacaaucgcuacaccgccaagcggcccuucgugaagcugaacguggagaccgacacggccgagauccgccugaugugcaccgauaccuaccucgacaccccgcggcccaacgacggguccaucacgggccccugcgagagcgauggcgacaagggguccggcgggaucaagggcggguucguccaccagcgcaugaaguccaagaucggccggugguacagccgcaccaugaguaagaccgagcggaugggcauggggcuguacgugaaguacgacggcgaccccugggccgacuccgaugcccuggcguucagcggggugauggucuccaugaaggagccgggcugguacagcuucggguuugagaucaaggacaagaagugcgacgugcccugcaucggcaucgagauggugcacgauggcgggaaggagaccuggcacuccgccgccacggccaucuacugccucaugggcagcgggcagcugcugugggacaccgucaccggcguggacauggcccucuga

SEQ ID NO: 30343 - RNA, 1401 nt, Artificial Sequence
  derived and/or modified CDS sequence (AUadapt) from InfluenzaB__AHL94661__NA
augcugcccaguaccauccagacccucacgcuguuccugaccuccggcggggugcuccugagccuguacgucuccgccucgcucuccuaccugcuguacagcgauauccuccugaaguucccguccaccgagaucaccgcccccacgaugccccuggacugcgcgaacgccagcaacgugcaggccgugaaccgcuccgccaccaagggcgucacccuccugcugcccgagccggaguggaccuauccccggcucucgugccccggguccacguuccagaaggcccugcugaucagcccccaccgcuucggcgagaccaaggggaacuccgcgccgcucaucauccgggagcccuuuaucgccugcggccccaaggagugcaagcacuucgcccugacccacuacgccgcgcagcccggcggguacuauaacggcacccgcggggaccggaacaagcugcgccaccucaucagcgugaagcugggcaagaucccgacgguggagaacuccaucuuccauauggccgccuggucgggguccgccugccacgacggcaaggaguggaccuacaucggcgucgacgggcccgacaauaacgcccugcucaagaucaaguacggcgaggcguacaccgacaccuaccacagcuaugccaacaacauccugcggacgcaggaguccgccugcaacugcaucgggggcaacugcuaucugaugaucaccgacggcucggccagcgggguguccgagugccgcuuccucaagauccgggagggccgcaucaucaaggagaucuuccccaccgggcggauccagcacaccgaggaguguacgugcggcuucgccagcaacaagaccaucgagugcgcgugccgcgacaauuccuacaccgccaagcggcccuucgugaagcugaacgucgagaccgacacggccgagauccgccugaugugcaccaagaccuaccucgacaccccgcggcccgaggaugggucgaucacgggccccugcgaguccaacggcgggaagggcagcgggggcaucaagggcggguucgugcaccagcgcauggccuccaagaucggccggugguacagucgcaccauguccaagaccgagcggaaggggaugggccuguacgugaaguacaacggggaccccugggccgacucggacgcgcuggucuuuuccggcgugauggugagcauggaggagccggggugguacuccuucggcuucgagaucaaggacaagaagugcgacguccccuguaucggcaucgagauggugcacgacgggggcaaggagaccuggcacagcgccgccacggccaucuacugccucaugggguccggccagcugcugugggacaccgugaccggcgucaacaugacccucuga

SEQ ID NO: 30344 - RNA, 1401 nt, Artificial Sequence
  derived and/or modified CDS sequence (AUadapt) from InfluenzaB__AHL94672__NA
augcugcccaguaccauccagacccucacgcuguuccugaccuccggcggggugcuccugagccuguacgucuccgccagccucuccuaccugcuguauagcgacauccuccugaaguucucccgcaccgagaucaccgccccgaucaugccccuggacugcgcgaacgccaguaacgugcaggccgugaaccgguccgccacgaagggcgucacgccccuccugcccgagccggaguggaccuacccccgccugucgugccccggguccaccuuccagaaggcccuccugaucaguccccaccgguucggcgagaccaaggggaacuccgcgccgcugaucauccgcgagcccuucaucgccugcggccccaaggaguguaagcacuucgcccucacccacuacgccgcgcagcccggcggguacuacaauggcacccgggaggaccgcaacaagcugcggcaccugaucagcgugaagcucgggaagaucccgaccguggagaacuccaucuuccauauggccgccuggagcggcuccgccugccacgacgggcgcgaguggacguacaucggcgucgauggccccgacagcaacgcccugcugaagaucaaguacggggaggcguacaccgacaccuaucacuccuacgccaagaacauccuccggacccaggagucggccugcaacuguaucggcggggacugcuaccugaugaucacggacggcagcgccuccggcaucagugagugccgcuuccugaagauccgggaggggcgcaucaucaaggagaucuuccccaccggccgggugaagcacaccgaggagugcacgugcggguuugccuccaacaagaccaucgagugcgcgugccgcgacaacagcuauaccgccaagcggcccuucgugaagcucaacgucgagaccgacaccgccgagauccgccugaugugcacggagaccuaccuggauaccccgcggcccaacgacggcuccaucagcgggcccugcgaguccaacggcgacgagggcagugggggcaucaagggcggguucgugcaccagcgcauggccuccaagaucgggcggugguacagccgcaccauguccaagacgaagcggaugggcaugggccucuacgugaaguacgauggggaccccuggaccgacagcgaggcccuggcgcuguccggcgucauggugagcauggaggagccggggugguacuccuuuggcuucgagaucaaggacaagaagugcgacgugcccugcaucgggaucgagaugguccacgauggcggcaagaccaccuggcacagcgccgccacggccaucuacugccucaugggguccggccagcugcugugggacaccgugaccggggugaacaugacccucuga

SEQ ID NO: 30345 - RNA, 1401 nt, Artificial Sequence
  derived and/or modified CDS sequence (AUadapt) from InfluenzaB__AHL94683__NA
augcugcccaguaccauccagacccucacgcuguuccugaccuccggcggggugcuccugagccuguacgucuccgccagccucuccuaccugcuguauagcgacauccuccugaaguucucccgcaccgagaucaccgccccgaucaugccccuggacugcgcgaaugccagcaacgugcaggccgugaaccgguccgccacgaagggcgucacgccccuccugcccgagccggaguggaccuacccccgccugucgugucccggguccaccuuccagaaggcccuccugaucagcccccaccgguucggcgagaccaaggggaacuccgcgccgcugaucauccgcgagcccuucaucgccuguggccccaaggagugcaagcacuucgcccucacccacuacgccgcgcagcccggcggguauuacaacggcacccgggaggaccgcaacaagcugcggcaccugaucagugugaagcucgggaagaucccgaccguggagaacuccaucuuccacauggccgccuggagcggcuccgccugccaugacgggcgcgaguggacguacaucggcgucgacggccccgacagcaacgcccugcugaagaucaaguauggggaggcguacaccgacaccuaccacuccuacgccaagaauauccuccggacccaggagucggccugcaacugcaucggcggggacuguuaccugaugaucacggacggcagcgccuccggcaucagcgagugccgcuuucugaagauccgggaggggcgcaucaucaaggagaucuuccccaccggccgggugaagcacaccgaggagugcacgugcggguucgccuccaacaagaccaucgagugugcgugccgcgacaacagcuacaccgccaagcggcccuuugugaagcucaacgucgagaccgacaccgccgagauccgccugaugugcacggagaccuaccuggacaccccgcggcccaaugacggcuccaucaccgggcccugcgagagcaacggcggcgagggguccggcgggaucaagggcggguucgugcaucagcgcauggccucgaagaucggccggugguacucccgcacgaugagcaagaccaagcggaugggcauggggcucuacgugaaguacgacggcgaucccuggaccgacuccgaggcccuggcgcugagcggggucaugguguccauggaggagccgggcugguacagcuucggguuugagaucaaggacaagaagugcgacgugcccugcaucggcaucgagaugguccacgauggcgggaagaccacguggcacuccgccgccaccgccaucuacugccucaugggcagcgggcagcugcugugggacaccgugaccggcgugaacaugacgcucuga

SEQ ID NO: 30346 - RNA, 1401 nt, Artificial Sequence
  derived and/or modified CDS sequence (AUadapt) from InfluenzaB__AHL94694__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccgcuccgccaccaagggcgucacccuccugcugcccgagccggaguggaccuacccccggcucagcugccccggguccacguuccagaaggcccugcugaucucgccccaucgcuucggcgagaccaaggggaacuccgcgccgcucaucauccgggagcccuucaucgccugcggccccaacgagugcaagcacuuugcccugacccacuacgccgcgcagcccggcggguacuacaacggcacccgcggggaccggaauaagcugcgccaccucaucagcgugaagcugggcaagaucccgacgguggagaacuccaucuuccacauggccgccuggagcggguccgccugucacgacggcaaggaguggaccuacaucggcgucgacgggcccgacaacaacgcccugcucaaggugaaguauggcgaggcguacaccgacaccuaccacucguacgccaauaagauccugcggacgcaggaguccgccugcaacugcaucgggggcaacugcuaccugaugaucaccgauggcagcgccagcgggguguccgagugccgcuuccucaagauccgggagggccgcaucaucaaggagaucuuccccaccgggcgggucaagcacaccgaggaguguacgugcggcuucgccucgaacaagaccaucgagugcgcgugccgcgacaaucgguacaccgccaagcgccccuucgugaagcugaacguggagaccgacacggccgagauccggcugaugugcaccgacaccuaucucgacaccccgcgccccaacgacggguccaucacgggccccugcgagagcgacggcgauaagggguccggcgggaucaagggcggguucguccaccagcggaugaaguccaagaucggccgcugguacagccggaccaugucgaagaccgagcgcaugggcauggggcuguacgugaaguacgauggcgaccccugggccgacuccgacgcccugaccuucagcggggugauggucuccaugaaggagccgggcugguacaguuucggguucgagaucaaggacaagaagugcgacgugcccugcaucggcaucgagauggugcaugacggcgggaaggagacguggcacuccgcggccaccgccaucuacugccucaugggcagcgggcagcugcugugggacaccgucaccggcguggacauggcccucuga

SEQ ID NO: 30347 - RNA, 1401 nt, Artificial Sequence; identical to SEQ ID NO: 28678
  derived and/or modified CDS sequence (AUadapt) from InfluenzaB__AHL94705__NA

SEQ ID NO: 30348 - RNA, 1401 nt, Artificial Sequence; identical to SEQ ID NO: 28686
  derived and/or modified CDS sequence (AUadapt) from InfluenzaB__AHL94716__NA

SEQ ID NO: 30349 - RNA, 1401 nt, Artificial Sequence
  derived and/or modified CDS sequence (AUadapt) from InfluenzaB__AHL94727__NA
augcugcccaguaccauccagacccucacgcuguuccugaccuccggcggggugcuccugagccuguacgucuccgccucgcucuccuaccugcuguacagcgauauccuccugaaguucccguccaccgagaucaccgcccccacgaugccccuggacugcgcgaacaccucgaacgugcaggccgugaaccgcuccgccaccaagggcgucacccuccugcugcccgagccggaguggacguacccccggcucaguugccccggguccaccuuccagaaggcccugcugaucagcccccaccgcuucggcgagaccaaggggaacuccgccccgcucaucauccgggagcccuucaucgcguguggccccaaggagugcaagcacuucgcccugacccacuacgccgcccagcccggcggguacuacaacggcacgcgcggggaucggaacaagcugcgccaccucaucucggugaagcugggcaagaucccgaccguggagaacuccaucuuccacauggcggccuggagcggguccgccugccaugacggcaaggaguggaccuacaucggcgucgacgggcccgacaacaacgcccugcucaagaucaaguacggcgaggccuauaccgacacguaccacucguacgcgaacaacauccugcggacccaggaguccgccugcaauugcaucgggggcaacugcuaccugaugaucaccgacggcagcgccucggggguguccgagugccgcuuucucaagauccgggagggccgcaucaucaaggagaucuuccccaccgggcggauccagcacacggaggagugcacgugcggcuucgccagcaacaagaccaucgagugugccugccgcgacaacuccuacaccgcgaagcggcccuucgugaagcugaacgucgagaccgacaccgccgagauccgccugaugugcaccaagaccuaucucgacacgccgcggcccgaggacgggagcaucaccggccccugcgaguccaacggcgggaagggcucggggggcaucaagggcggguucgugcaccagcgcauggccuccaagaucggccggugguauagccgcaccauguccaagaccgagcggaaggggaugggccuguacgugaaguacaacggggaccccugggccgacucggaugcccuggucuucuccggcgugauggugagcauggaggagccggggugguacuccuucggcuucgagaucaaggacaagaagugcgacguccccuguaucggcaucgagauggugcacgacgggggcaaggagacguggcacagcgcggccaccgccaucuacugccucaugggguccggccagcugcugugggacaccgugaccggcgucaacaugacgcucuga

SEQ ID NO: 30350 - RNA, 1401 nt, Artificial Sequence; identical to SEQ ID NO: 28686
  derived and/or modified CDS sequence (AUadapt) from InfluenzaB__AHL94738__NA

SEQ ID NO: 30351 - RNA, 1401 nt, Artificial Sequence
  derived and/or modified CDS sequence (AUadapt) from InfluenzaB__AHL94749__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuucagaaggcccugcugaucagcccccaccgcuucggcgagaccaaggggaacuccgcgccgcucaucauccgggagcccuucaucgccugcggccccaaugagugcaagcacuucgcccugacccacuacgccgcgcagcccggcggguauuacaacggcacccgcggggaccggaacaagcugcgccaccucaucagcgugaagcugggcaagaucccgacgguggagaauuccaucuuccacauggccgccuggagcggguccgccugccacgauggcaaggaguggaccuacaucggcgucgacgggcccgacaacaacgcccugcucaaggugaaguacggcgaggcguauaccgacaccuaccacucguacgccaauaagauccugcggacgcaggaguccgccugcaacugcaucgggggcaacugcuaccugaugaucaccgauggcagcgccagcgggguguccgagugccgcuuccucaagauccgggagggccgcaucaucaaggagaucuuccccaccgggcgggucaagcauaccgaggagugcacgugcggcuucgccagcaacaagaccaucgagugcgcgugucgcgacaaccgguacaccgccaagcgccccuucgugaagcugaacguggagaccgauacggccgagauccggcugaugugcaccgacaccuaccucgacaccccgcgccccaacgacggguccaucacgggccccugugagagcgacggcgacaagggguccggcgggaucaagggcggguucguccaccagcggaugaaguccaagaucggccgcugguauucgcggaccaugagcaagaccgagcgcaugggcauggggcuguacgugaaguacgacggcgaccccugggccgauuccgacgcccuggcguucagcggggugauggucuccaugaaggagccgggcugguacagcuuuggguucgagaucaaggacaagaagugcgacgugcccugcaucggcguggagaugguccacgauggcgggaaggagaccuggcacuccgccgccacggccaucuacugccucaugggcagcgggcagcugcugugggacaccgugaccggcguggacauggcccucuga

SEQ ID NO: 30352 - RNA, 1401 nt, Artificial Sequence
  derived and/or modified CDS sequence (AUadapt) from InfluenzaB__AHL94760__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaacgccaguaacgugcaggccgugaaccacuccgccgccaagggcgucacgcuccugcugcccgagcccgaguggaccuacccgcgccucagcugccccggguccaccuuucagaaggcgcugcugaucagcccccaccgguucggcgagaucaaggggaacuccgcgccccucaucauccgcgagccguucaucgccuguggccccaccgagugcaagcacuucgcccugacgcacuacgccgcccagcccggcggguacuauaacggcacccgggaggaccgcaacaagcugcggcaccucaucagcgugaagcuggggaagauccccaccguggagaacuccaucuuucacauggccgccuggagcggcuccgccugccacgacgggaaggaguggaccuauaucggcgucgacggcccggacucgaacgcgcugcucaagaucaaguacggggaggccuacacggauaccuaccacuccuacgccaagaacauccugcgcacccaggagagcgccugcaauugcaucggcggggacugcuaccugaugaucaccgacggccccgccaguggcguguccgagugccgguuccucaagauccgcgaggggcggaucaucaaggagaucuuccccacgggccgcgugaagcacaccgaggagugcacgugcggguuugcgagcaacaagaccaucgagugcgccugccgggacaaccgcuauaccgccaagcggcccuucgucaagcugaacguggagaccgacaccgccgagauccgccugaugugcaccgagacguaccucgauaccccgcggcccaacgacggcuccaucaccgggcccugcgagagcgacggcgacaagggcuccgggggcaucaagggcggguuugugcaccagcgcauggccucgaagaucgggcggugguacucccgcaccaugagcaagacgaagcggaugggcaugggccuguacgucaaguacgauggggaccccuggaccgacuccgaggcgcuggcccucagcggcgugaugguguccauggaggagccggggugguacagcuuuggcuucgagaucaaggacaagaagugcgacauccccugcaucgggaucgagaugguccacgauggcggcaagaccaccuggcacuccgccgccacggccaucuacugccugauggggagcggccagcugcucugggacaccgugaccgggguggacauggcgcuguga

SEQ ID NO: 30353 - RNA, 1401 nt, Artificial Sequence; identical to SEQ ID NO: 28678
  derived and/or modified CDS sequence (AUadapt) from InfluenzaB__AHL94770__NA

SEQ ID NO: 30354 - RNA, 1401 nt, Artificial Sequence; identical to SEQ ID NO: 30317
  derived and/or modified CDS sequence (AUadapt) from InfluenzaB__AHL94781__NA

SEQ ID NO: 30355 - RNA, 1401 nt, Artificial Sequence; identical to SEQ ID NO: 30315
  derived and/or modified CDS sequence (AUadapt) from InfluenzaB__AHL94791__NA

SEQ ID NO: 30356 - RNA, 1401 nt, Artificial Sequence; identical to SEQ ID NO: 30346
  derived and/or modified CDS sequence (AUadapt) from InfluenzaB__AHL94801__NA

SEQ ID NO: 30357 - RNA, 1401 nt, Artificial Sequence; identical to SEQ ID NO: 30315
  derived and/or modified CDS sequence (AUadapt) from InfluenzaB__AHL94812__NA

SEQ ID NO: 30358 - RNA, 1401 nt, Artificial Sequence; identical to SEQ ID NO: 30315
  derived and/or modified CDS sequence (AUadapt) from InfluenzaB__AHL94821__NA

SEQ ID NO: 30359 - RNA, 1401 nt, Artificial Sequence; identical to SEQ ID NO: 28678
  derived and/or modified CDS sequence (AUadapt) from InfluenzaB__AHL94831__NA

SEQ ID NO: 30360 - RNA, 1401 nt, Artificial Sequence
  derived and/or modified CDS sequence (AUadapt) from InfluenzaB__AHL94840__NA
augcugcccaguaccauccagacccucacgcuguuccugaccuccggcggggugcuccugagccuguacgucuccgccagccucuccuaccugcuguauagcggcauccuccugaaguucucccgcaccgagaucaccgccccgaucaugccccuggacugcgcgaacgccucgaaugugcaggccgugaaccgguccgccacgaagggggucacccuccugcugcccgagcccgaguggaccuacccgcgccucagcugccccggcuccaccuuccagaaggcccugcugaucaguccccaccgguucggggagacgaagggcaacuccgcgccccucaucauccgcgagccguucaucgccugcggccccaaggagugcaagcauuucgcccugacccacuacgccgcgcagcccgggggcuacuacaaugggacccgggaggaccgcaacaagcugcggcaccucaucagcgugaagcugggcaagauccccaccguggagaacuccaucuuccauauggccgccuggagcggguccgccugccacgacggccgcgaguggacguacaucggcgucgaugggccggacucgaacgcccugcucaagaucaaguacggcgaggcguacaccgacaccuaucacuccuacgccaagaacauccugcggacccaggagagcgccugcaacuguaucgggggcgacugcuaccugaugaucacggacggccccgccagcgggaucuccgagugucgcuuccucaagauccgggagggccgcaucaucaaggagaucuuccccaccgggcgggugaagcacaccgaggagugcacgugcggcuucgccaguaacaagaccaucgagugcgcgugccgcgacaacuccuauaccgccaagcggcccuucgugaagcugaacgucgagaccgacaccgccgagauccgccugaugugcacggagaccuaccucgacaccccgcggcccaaugacgggagcaucaccggccccugcgaguccaacggcgacaaggggaguggcgggaucaagggcggguucgugcaccagcgcauggccuccaagaucggccggugguacagccgcacgauguccaagaccaagcggaugggcauggggcuguacgugaaguacgauggcgaccccuggaccgacagcgaggcccuggcgcucuccggggucauggugagcauggaggagccgggcugguacuccuuuggguucgagaucaaggacaagaagugcgacgugcccugcaucggcaucgagaugguccacgauggcgggaagaccacguggcacagcgccgccaccgccaucuacugccugaugggcuccgggcagcugcucugggacaccgugaccggcgugaacaugacgcuguga

SEQ ID NO: 30361 - RNA, 1401 nt, Artificial Sequence
  derived and/or modified CDS sequence (AUadapt) from InfluenzaB__AHL94851__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcacgaacgcgaguaacgugcaggccgugaaccgcuccgccgccaagggcgucacccuccugcugcccgagcccgaguggaccuacccgcggcucagcugccccggguccaccuuucagaaggcccugcugaucagcccccaccgcuucggcgagaucaaggggaacuccgcgccccucaucauccgggagccguucaucgccugcggccccacggaguguaagcacuucgcccugacccacuacgccgcgcagcccggcggguacuacaauggcacccgcgaggaccggaacaagcugcgccaccucaucagcgugaagcuggggaagauccccaccguggagaacuccaucuuucacauggccgccuggagcggcuccgccugccacgacgggaaggaguggacguacaucggcgucgauggcccggacucgaacgcccugcucaagaucaaguacggggaggcguacaccgauaccuaccacuccuacgccaagaacauccugcggacccaggagagcgccugcaauugcaucggcggggacugcuaccugaugaucacggacggccccgccagcggcguguccgagugucgcuuccucaagauccgggaggggcgcaucaucaaggagaucuuccccaccggccgggugaagcacaccgaggagugcacgugcggguuugccagcaacaagaccaucgagugcgcgugccgcgacaaccgguauaccgccaagcgccccuucgucaagcugaacguggagaccgacaccgccgagauccggcugaugugcacggagaccuaccucgauaccccgcgccccaacgacggcuccaucaccgggcccugcgagagcgacggcgacaagggcuccgggggcaucaagggcggguuugugcaccagcggaugacgucgaagaucgggcgcugguacucccggaccaugagcaagaccaagcgcaugggcaugggccuguacgucaaguacgauggggaccccuggaccgacuccgaggcccuggcccucagcggcgugaugguguccauggaggagccggggugguacagcuuuggcuucgagaucaaggacaagaagugcgacguccccugcaucgggaucgagauggugcacgauggcggcaagacgaccuggcacuccgcggccaccgccaucuacugccugauggggagcggccagcugcucugggacaccgugacgggggucgacauggcccuguga

SEQ ID NO: 30362 - RNA, 1401 nt, Artificial Sequence; identical to SEQ ID NO: 28748
  derived and/or modified CDS sequence (AUadapt) from InfluenzaB__AHL94862__NA

SEQ ID NO: 30363 - RNA, 1401 nt, Artificial Sequence; identical to SEQ ID NO: 28686
  derived and/or modified CDS sequence (AUadapt) from InfluenzaB__AHL94873__NA

SEQ ID NO: 30364 - RNA, 1401 nt, Artificial Sequence; identical to SEQ ID NO: 30234
  derived and/or modified CDS sequence (AUadapt) from InfluenzaB__AHL94884__NA

SEQ ID NO: 30365 - RNA, 1401 nt, Artificial Sequence; identical to SEQ ID NO: 28640
  derived and/or modified CDS sequence (AUadapt) from InfluenzaB__AHL94893__NA

SEQ ID NO: 30366 - RNA, 1401 nt, Artificial Sequence; identical to SEQ ID NO: 28640
  derived and/or modified CDS sequence (AUadapt) from InfluenzaB__AHL94904__NA

SEQ ID NO: 30367 - RNA, 1401 nt, Artificial Sequence
  derived and/or modified CDS sequence (AUadapt) from InfluenzaB__AHL94915__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccucgaauguccagguggugaaccgcuccgccaccaagggcgugacccuccugcugcccgagccggaguggaccuacccccggcucagcugccccggguccacguuccagaaggcccugcugaucagcccccaucgcuucggcgagaccaaggggaacuccgccccgcucaucauccgggagcccuucaucgcgugcggccccaacgagugcaagcacuuugcccugacccacuacgccgcccagcccggcggguacuacaacggcacccgcggggaccggaauaagcugcgccaccucaucagcgugaagcugggcaagaucccgacggucgagaacuccaucuuccacauggcggccuggagcggguccgccugucacgacggcaaggaguggaccuacaucggcguggacgggcccgacaacaacgcccugcucaaggugaaguauggcgaggccuacaccgacaccuaccacucguacgcgaauaagauccugcggacgcaggaguccgccugcaacugcaucgggggcaacugcuaccugaugaucaccgauggcagcgccagcggggucuccgagugccgcuuccucaagauccgggagggccgcaucaucaaggagaucuuccccaccgggcgggugaagcacaccgaggaguguacgugcggcuucgccagcaacaagaccaucgagugcgccugccgcgacaauuccuacaccgcgaagcggcccuucgugaagcugaacgucgagaccgacacggccgagauccgccugaugugcaccgacaccuaucucgacaccccgcggcccgacgacgggagcaucacgggccccugcgaguccaacggcgauaaggggucgggcgggaucaagggcggguucgugcaccagcgcauggaguccaagaucggccggugguacagccgcaccauguccaagaccgagcggaugggcauggggcuguacgugaaguacgauggcgaccccugggccgacagcgacgcccuggccuucuccggggucauggugagcaugaaggagccgggcugguauuccuucggguucgagaucaaggacaagaagugcgacgugcccugcaucggcaucgagaugguccaugacggcgggaaggagaccuggcacagcgcggccacggccaucuacugccucaugggcuccgggcagcugcugugggacaccgugaccggcguggacauggcccucuga

SEQ ID NO: 30368 - RNA, 1401 nt, Artificial Sequence; identical to SEQ ID NO: 30234
  derived and/or modified CDS sequence (AUadapt) from InfluenzaB__AHL94926__NA

SEQ ID NO: 30369 - RNA, 1401 nt, Artificial Sequence
  derived and/or modified CDS sequence (AUadapt) from InfluenzaB__AHL94937__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgcugccccucgacugcgcgaacgccaguaacgugcaggccgugaaccgcuccgccaccaagggcgucacccugcugcuccccgagccggaguggaccuacccccggcugagcugccccggguccacguuccagaaggcccugcucaucaguccccaccgcuucggcgagaccaaggggaacuccgcgccgcugaucauccgggagcccuucaucgccugcggccccaacgaguguaagcacuucgcccugacccacuacgccgcgcagcccggcggguacuacaauggcacccgcggggaccggaacaagcuccgccaccugaucagcgugaagcugggcaagaucccgacgguggagaacuccaucuuccauauggccgccuggagcggguccgccugccacgacggcaaggaguggaccuacaucggcgucgacgggcccgauaacaacgcccuccugaaggugaaguacggcgaggcguacaccgacaccuaccauucguacgccaacaagauccugcggacgcaggaguccgccugcaacugcaucgggggcaauugcuaccucaugaucaccgacggcagcgccagcgggguguccgagugucgcuuccugaagauccgggagggccgcaucaucaaggagaucuuccccaccgggcgggucaagcacaccgaggagugcacgugcggcuucgccaguaacaagaccaucgagugcgcgugccgcgacaacuccuacaccgccaagcggcccuuugugaagcugaacguggagaccgacacggccgagauccgccucaugugcaccgacaccuaccuggacaccccgcggcccaaugacgggagcaucacgggccccugcgaguccaacggcgacaaggggucgggcgggaucaagggcggguuuguccaccagcgcauggaguccaagaucggccggugguacagccgcaccauguccaagaccgagcggaugggcauggggcuguacgugaaguacgacggcgaucccugggccgacagcgacgcccucgcguucuccggggugauggucagcaugaaggagccgggcugguacuccuuuggguucgagaucaaggacaagaagugcgacgugcccugcaucggcaucgagauggugcacgauggcgggaaggagaccuggcacagcgccgccacggccaucuacugccugaugggcuccgggcagcugcucugggacaccgucaccggcguggacauggcccuguga

SEQ ID NO: 30370 - RNA, 1401 nt, Artificial Sequence; identical to SEQ ID NO: 30253
  derived and/or modified CDS sequence (AUadapt) from InfluenzaB__AHL94948__NA

SEQ ID NO: 30371 - RNA, 1401 nt, Artificial Sequence; identical to SEQ ID NO: 29069
  derived and/or modified CDS sequence (AUadapt) from InfluenzaB__AHL94959__NA

SEQ ID NO: 30372 - RNA, 1401 nt, Artificial Sequence; identical to SEQ ID NO: 29069
  derived and/or modified CDS sequence (AUadapt) from InfluenzaB__AHL94969__NA

SEQ ID NO: 30373 - RNA, 1401 nt, Artificial Sequence; identical to SEQ ID NO: 29069
  derived and/or modified CDS sequence (AUadapt) from InfluenzaB__AHL94978__NA

SEQ ID NO: 30374 - RNA, 1401 nt, Artificial Sequence
  derived and/or modified CDS sequence (AUadapt) from InfluenzaB__AHM00990__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcacgaacgcgaguaacgugcaggccgugaaccacuccgccgccaagggcgucacccuccugcugcccgagcccgaguggaccuacccgcgccucagcugccccggguccaccuuucagaaggcccugcugaucagcccccaccgguucggcgagaucaaggggaacuccgcgccccucaucauccgcgagccguucaucgccuguggccccacggagugcaagcacuucgcccugacccacuacgccgcgcagcccggcggguacuauaacggcacccgggaggaccgcaacaagcugcggcaccucaucagcgugaagcuggggaagauccccaccguggagaacuccaucuuucacauggccgccuggagcggcuccgccugccacgacgggaaggaguggacguauaucggcgucgacggcccggacucgaacgcccugcucaagaucaaguacggggaggcguacaccgauaccuaccacuccuacgccaagaacauccugcgcacccaggagagcgccugcaauugcaucggcggggacugcuaccugaugaucacggacggccccgccaguggcguguccgagugccgguuccucaagauccgcgaggggcggaucaucaaggagaucuuccccaccggccgcgugaagcacaccgaggagugcacgugcggguuugccagcaacaagaccaucgagugcgcgugccgggacaaccgcuauaccgccaagcggcccuucgucaagcugaacguggagaccgacaccgccgagauccgccugaugugcacggagaccuaccucgauaccccgcggcccaacgacggcuccaucaccgggcccugcgagagcgacggcgacaagggcuccgggggcaucaagggcggguuugugcaccagcgcauggccucgaagaucgggcggugguacucccgcacgaugagcaagaccaagcggaugggcaugggccuguacgucaaguacgauggggaccccuggaccgacuccgaggcccuggcgcucagcggcgugaugguguccauggaggagccggggugguacagcuuuggcuucgagaucaaggacaagaagugcgacguccccugcaucgggaucgagauggugcacgauggcggcaagaccacguggcacuccgccgccaccgccaucuacugccugauggggagcggccagcugcucugggacaccgugaccggggucgacauggcccuguga

SEQ ID NO: 30375 - RNA, 1401 nt, Artificial Sequence; identical to SEQ ID NO: 28678
  derived and/or modified CDS sequence (AUadapt) from InfluenzaB__AHM01001__NA

SEQ ID NO: 30376 - RNA, 1401 nt, Artificial Sequence
  derived and/or modified CDS sequence (AUadapt) from InfluenzaB__AHM01012__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccgcuccgccaccaagggcgucacccuccugcugcccgagccggaguggaccuacccccggcucagcugccccggguccacguuccagaaggcccugcugaucucgccccaucgcuucggcgagaccaaggggaacuccgcgccgcucaucauccgggagcccuucaucgccugcggccccaacgagugcaagcacuuugcccugacccacuacgccgcgcagcccggcggguacuacaacggcacccgcggggaccggaauaagcugcgccaccucaucagcgugaagcugggcaagaucccgacgguggagaacuccaucuuccacauggccgccuggagcggguccgccugucacgacggcaaggaguggaccuacaucggcgucgacgggcccgacaacaacgcccugcucaaggugaaguauggcgaggcguacaccgacaccuaccacucguacgccaauaagauccugcggacgcaggaguccgccugcaacugcaucgggggcaacugcuaccugaugaucaccgauggcagcgccagcgggguguccgagugccgcuuccucaagauccgggagggccgcaucaucaaggagaucuuccccaccgggcgggucaagcacaccgaggaguguacgugcggcuucgccucgaacaagaccaucgagugcgcgugccgcgacaaucgguacaccgccaagcgccccuucgugaagcugaacguggagaccgacacggccgagauccggcugaugugcaccgacaccuaucucgacaccccgcgccccaacgacggguccaucacgggccccugcgagagcgacggcgauaagggguccggcgggaucaagggcggguucguccaccagcggaugaaguccaagaucggccgcugguacagccggaccaugucgaagaccgagcgcaugggcauggggcuguacgugaaguacgauggcgaccccuggaccgacuccgacgcccuggccuucagcggggugauggucuccaugaaggagccgggcugguacaguuucggguucgagaucaaggacaagaagugcgacgugcccugcaucggcaucgagauggugcaugacggcgggaaggagacguggcacuccgcggccaccgccaucuacugccucaugggcagcgggcagcugcugugggacaccgucaccggcguggacauggcccucuga

SEQ ID NO: 30377 - RNA, 1401 nt, Artificial Sequence; identical to SEQ ID NO: 28678
  derived and/or modified CDS sequence (AUadapt) from InfluenzaB__AHM01023__NA

SEQ ID NO: 30378 - RNA, 1401 nt, Artificial Sequence; identical to SEQ ID NO: 28678
  derived and/or modified CDS sequence (AUadapt) from InfluenzaB__AHM01034__NA

SEQ ID NO: 30379 - RNA, 1401 nt, Artificial Sequence
  derived and/or modified CDS sequence (AUadapt) from InfluenzaB__AHM01045__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccagcaacgugcaggccgugaaccgcuccgccaccaagggcgucacccuccugcugcccgagccgggguggaccuacccccggcucagcugucccggcuccacguuccagaaggcccugcugaucucgccccaccgcuucggggagaccaagggcaacuccgcgccgcucaucauccgggagcccuuuaucgccugcggccccaacgagugcaagcacuucgcccugacccacuaugccgcgcagcccgggggcuacuacaacgggacccgcggcgaccggaacaagcugcgccaucucaucagcgugaagcuggggaagaucccgacgguggagaacuccaucuuccacauggccgccuggagcggcuccgccugucacgacggcaaggaguggaccuacaucggggucgacggccccgacaauaacgcccugcucaaggugaaguacggggaggcguacaccgacaccuaccauagcuacgccaacaagauccugcggacgcaggaguccgccugcaacugcaucggcggcaauugcuaccugaugaucaccgacgggagcgccagcggcguguccgagugucgcuuccucaagauccgggaggggcgcaucaucaaggagaucuuccccaccggccgggucaagcacaccgaggagugcacgugcggguuugccucgaacaagaccaucgagugcgcgugccgcgacaaucgguacaccgccaagcgccccuucgugaagcugaacguggagaccgacacggccgagauccggcugaugugcaccgauaccuaccucgacaccccgcgccccaacgacggcuccaucacgggccccugcgagagcgauggggacaagggcuccgggggcaucaagggcggguucguccaccagcggaugaaguccaagaucggccgcugguacagccggaccaugaguaagaccgagcgcauggggaugggccuguacgugaaguacgacggggaccccugggccgacuccgaugcccuggcguucagcggcgugauggucuccaugaaggagccggggugguacagcuucggcuuugagaucaaggacaagaagugcgacgugcccugcaucggcaucgagauggugcacgaugggggcaaggagaccuggcacuccgccgccacggccaucuacugccucauggggagcggccagcugcugugggacaccgucgccggcguggacauggcgcucuga

SEQ ID NO: 30380 - RNA, 1401 nt, Artificial Sequence
  derived and/or modified CDS sequence (AUadapt) from InfluenzaB__AHM01056__NA
augcugcccaguaccacccagacgcucacccuguuccugaccuccggcggggugcuccugagccuguacgucuccgccagccucuccuaccugcuguauucggacauccuccugaaguucuccccgaccgagaucacggcccccaccaugccccuggacugcgcgaacgccaguaacgugcaggccgugaaccgcuccgccaccaagggcgucacccuccugcugcccgagccggaguggacguacccccggcucagcugccccggguccaccuuccagaaggcccugcugaucaguccccaccgcuucggcgagaccaaggggaacuccgcgccgcucaucauccgggagcccuucaucgccugcggccccaacgaguguaagcacuucgcccugacccacuacgccgcgcagcccggcggguacuacaauggcacgcgcggggaccggaacaagcugcgccaccucaucucggugaagcugggcaagaucccgaccguggagaacuccaucuuccauauggccgccuggagcggguccgccugccacgacggcaaggaguggaccuacaucggcgucgacgggcccgauaacaacgcccugcucaaggugaaguacggcgaggcguacaccgacacguaccauagcuacgccaacaagauccugcggacccaggaguccgccugcaacugcaucgggggcaauugcuaccugaugaucaccgacggcagcgccucggggguguccgagugucgcuuccucaagauccgggagggccgcaucaucaaggagaucuuccccaccgggcgggucaagcacacggaggagugcacgugcggcuucgccaguaacaagaccaucgagugcgcgugccgcgacaaccgguacaccgccaagcgccccuuugugaagcugaacguggagaccgacaccgccgagauccggcugaugugcaccgacaccuaccucgacacgccgcgccccaaugacggguccaucaccggccccugcgagagcgacggcgacaagggguccggcgggaucaagggcggguucguccaucagcggaugaaguccaagaucggccgcugguacagccggaccaugucgaagaccgagcgcaugggcauggggcuguacgugaaguacgacggcgaucccugggccgacuccgacgcccugguguucagcggggucaugguguccaugaaggagccgggcugguacagcuuuggguucgagaucaaggacaagaagugcgacgugcccugcaucggcaucgagaugguccacgauggcgggaaggagacguggcacuccgcggccaccgccaucuacugccucaugggcagcgggcagcugcugugggacaccgugaccggcguggacauggcccucuga

SEQ ID NO: 30381 - RNA, 1401 nt, Artificial Sequence; identical to SEQ ID NO: 28678
  derived and/or modified CDS sequence (AUadapt) from InfluenzaB__AHM01067__NA

SEQ ID NO: 30382 - RNA, 1401 nt, Artificial Sequence; identical to SEQ ID NO: 28675
  derived and/or modified CDS sequence (AUadapt) from InfluenzaB__AHM01078__NA

SEQ ID NO: 30383 - RNA, 1401 nt, Artificial Sequence
  derived and/or modified CDS sequence (AUadapt) from InfluenzaB__AHM01089__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccgccaagggcgucacccuccugcugcccgagccggaguggaccuacccccggcucagcugccccggguccaccuuucagaaggcgcugcugaucagcccccaccgcuucggcgagacgaaggggaacuccgccccgcucaucauccgggagcccuucaucgccugcggccccaaugagugcaagcacuucgcccugacccacuacgcggcccagcccggcggguauuacaacggcacccgcggggaccggaacaagcugcgccaccucaucagcgugaagcugggcaagaucccgaccguggagaauuccaucuuccacauggccgccuggagcggguccgccugccacgauggcaaggaguggacguacaucggcgucgacgggcccgacaacaacgcgcugcucaaggugaaguacggcgaggccuauaccgacaccuaccacucguacgccaauaagauccugcggacccaggaguccgccugcaacugcaucgggggcaacugcuaccugaugaucacggauggcagcgccagcgggguguccgagugccgcuuccucaagauccgggagggccgcaucaucaaggagaucuuccccaccgggcgggucaagcauaccgaggagugcacgugcggcuucgcgagcaacaagaccaucgagugcgccugucgcgacaaccgguacaccgccaagcgccccuucgugaagcugaacguggagaccgauaccgccgagauccggcugaugugcacggacaccuaccucgacaccccgcgccccaacgacggguccaucaccggccccugugagagcgacggcgacaagggguccggcgggaucaagggcggguucguccaccagcggaugaaguccaagaucggccgcugguauucgcggacgaugagcaagaccgagcgcaugggcauggggcuguacgugaaguacgacggcgaccccugggccgauuccgacgcgcuggccuucagcggggugauggucuccaugaaggagccgggcugguacagcuuuggguucgagaucaaggacaagaagugcgacgugcccugcaucggcaucgagauggugcacgauggcgggaaggagaccuggcacuccgccgccaccgccaucuacugccucaugggcagcgggcagcugcugugggacacggucaccggcguggacauggcgcucuga

SEQ ID NO: 30384 - RNA, 1401 nt, Artificial Sequence; identical to SEQ ID NO: 28675
  derived and/or modified CDS sequence (AUadapt) from InfluenzaB__AHM01100__NA

SEQ ID NO: 30385 - RNA, 1401 nt, Artificial Sequence; identical to SEQ ID NO: 28678
  derived and/or modified CDS sequence (AUadapt) from InfluenzaB__AHM01111__NA

SEQ ID NO: 30386 - RNA, 1401 nt, Artificial Sequence
  derived and/or modified CDS sequence (AUadapt) from InfluenzaB__AHM01122__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccgcuccgccaccaagggcgucaagcuccugcugcccgagccggaguggaccuacccccggcucagcugccccggguccaccuuccagaaggcccugcugaucucgccccaucgcuucggcgagacgaaggggaacuccgcgccgcucaucauccgggagcccuucaucgccugcggccccaacgagugcaagcacuuugcccugacccacuacgccgcgcagcccggcggguacuacaacggcacccgcggggaccggaauaagcugcgccaccucaucagcgugaagcugggcaagaucccgaccguggagaacuccaucuuccacauggccgccuggagcggguccgccugucacgacggcaaggaguggacguacaucggcgucgacgggcccgacaacaacgcccugcucaaggugaaguauggcgaggcguacaccgacaccuaccacucguacgccaauaagauccugcggacccaggaguccgccugcaacugcaucgggggcaacugcuaccugaugaucacggauggcagcgccagcgggguguccgagugccgcuuccucaagauccgggagggccgcaucaucaaggagaucuuccccaccgggcgggucaagcacaccgaggaguguacgugcggcuucgccucgaacaagaccaucgagugcgcgugccgcgacaaucgguacaccgccaagcgccccuucgugaagcugaacguggagaccgacaccgccgagauccggcugaugugcacggacaccuaucucgacaccccgcgccccaacgacggguccaucaccggccccugcgagagcgacggcgauaagggguccggcgggaucaagggcggguucguccaccagcggaugaaguccaagaucggccgcugguacagccggacgaugucgaagaccgagcgcaugggcauggggcuguacgugaaguacgauggcgaccccugggccgacuccgacgcccuggcguucagcggggugauggucuccaugaaggagccgggcugguacaguuucggguucgagaucaaggacaagaagugcgacgugcccugcaucggcaucgagauggugcaugacggcgggaaggagaccuggcacuccgccgccaccgccaucuacugccucaugggcagcgggcagcugcugugggacacggucaccggcguggacauggcccucuga

SEQ ID NO: 30387 - RNA, 1401 nt, Artificial Sequence; identical to SEQ ID NO: 28678
  derived and/or modified CDS sequence (AUadapt) from InfluenzaB__AHM01133__NA

SEQ ID NO: 30388 - RNA, 1401 nt, Artificial Sequence
  derived and/or modified CDS sequence (AUadapt) from InfluenzaB__AHM01144__NA
augcugcccaguaccauccagacccucacgcuguuccugaccuccggcggggugcuccugagccuguacgucuccgccagccucuccuaccugcuguauucggacauccuccugaaguucuccccgaccgagaucaccgcccccacgaugccccuggacugcgcgaacgccaguaacgugcaggccgugaaccgcuccgccgccaagggcgucacccuccugcugcccgagccggaguggaccuacccccggcucagcugccccggguccaccuuccagaaggcgcugcugaucaguccccaccgcuucggcgagacgaaggggaacuccgccccgcucaucauccgggagcccuucaucgccugcggccccaacgaguguaagcacuucgcccugacccacuacgcggcccagcccggcggguacuacaauggcacccgcggggaccggaacaagcugcgccaccucaucucggugaagcugggcaagaucccgaccguggagaacuccaucuuccauauggccgccuggagcggguccgccugccacgacggcaaggaguggacguacaucggcgucgacgggcccgauaacaacgcgcugcucaaggugaaguacggcgaggccuacaccgacaccuaccauagcuacgccaacaagauccugcggacccaggaguccgccugcaacugcaucgggggcaauugcuaccugaugaucacggacggcagcgccucggggaucuccgagugucgcuuccucaagauccgggagggccgcaucaucaaggagaucuuccccaccgggcgggugaagcacaccgaggagugcacgugcggcuucgcgaguaacaagaccaucgagugcgccugccgcgacaaccgguacaccgccaagcgccccuuugucaagcugaacguggagaccgacaccgccgagauccggcugaugugcacggacaccuaccucgacaccccgcgccccaaugacggguccaucaccggccccugcgagagcgacggcgacaagggguccggcgggaucaagggcggguucgugcaucagcggaugaaguccaagaucggccgcugguacagccggacgaugucgaagaccgagcgcaugggcauggggcuguacgucaaguacgacggcgaucccugggccgacuccgacgcgcuggccuucagcggggugaugguguccaugaaggagccgggcugguacagcuuuggguucgagaucaaggacaagaagugcgacguccccugcaucggcaucgagauggugcacgauggcgggaaggagaccuggcacuccgccgccaccgccaucuacugccucaugggcagcgggcagcugcugugggacacggugaccggcgucgacauggcgcucuga

SEQ ID NO: 30389 - RNA, 1401 nt, Artificial Sequence; identical to SEQ ID NO: 28678
  derived and/or modified CDS sequence (AUadapt) from InfluenzaB__AHM01166__NA

SEQ ID NO: 30390 - RNA, 1401 nt, Artificial Sequence
  derived and/or modified CDS sequence (AUadapt) from InfluenzaB__AHM01188__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaacgugcaggccgugaaucacuccgccaccaagggcgucacccuccugcugcccgagccggaguggaccuacccccgccucagcugccccggguccacguuccagaaggcccugcugaucucgccccaccgguuuggcgagaccaaggggaacuccgcgccgcucaucauccgcgagcccuucaucgccugcggccccaacgagugcaagcacuucgcccugacccauuacgccgcgcagcccggcggguacuacaacggcacccgcggggaccggaacaagcugcggcaccucaucagugugaagcugggcaagaucccgacgguggagaacuccaucuuccacauggccgccuggagcggguccgccugccacgauggcaaggaguggaccuacaucggcgucgacgggcccgacaacaacgcccugcucaaggugaaguacggcgaggcguacaccgauaccuaccacucguacgccaacaagauccugcgcacgcaggaguccgccugcaacuguaucgggggcaacugcuaccugaugaucaccgacggcagcgccagcgggguguccgagugccgguuucucaagauccgcgagggccggaucaucaaggagaucuuccccaccgggcgcgucaagcacaccgaggagugcacgugcggcuucgccucgaacaagaccaucgagugugcgugccgggacaaccgcuacaccgccaagcggcccuucgugaagcugaacguggagaccgauacggccgagauccgccugaugugcaccgacaccuaccucgacaccccgcggcccaacgacggguccaucacgggccccugcgagagugacggcgacaagggguccggcgggaucaagggcggguucguccaccagcgcaugaaguccaagaucggccggugguacagccgcaccaugucgaagaccgagcggaugggcauggggcuguaugugaaguacgacggcgaccccugggccgacuccgacgcccugguguucagcggggucaugguguccaugaaggagccgggcugguauagcuucggguucgagaucaaggacaagaagugcgacgugcccugcaucggcaucgagaugguccaugacggcgggaaggagaccuggcacuccgcggccacggccaucuacugccucaugggcagcgggcagcugcugugggacaccgugaccggcguggacauggcccucuga

SEQ ID NO: 30391 - RNA, 1401 nt, Artificial Sequence; identical to SEQ ID NO: 30383
  derived and/or modified CDS sequence (AUadapt) from InfluenzaB__AHM01199__NA

SEQ ID NO: 30392 - RNA, 1401 nt, Artificial Sequence
  derived and/or modified CDS sequence (AUadapt) from InfluenzaB__AHM01210__NA
augcugcccaguaccauccagacccucacgcuguuccugaccuccggcggggugcuccugagccuguacgucuccgccagccucuccuaucugcuguacagcgacauccuccugaaguucuccccgaccgagaucaccgcccccacgaugccccuggacugugcgaacgccagcaacgugcaggccgugaaccgcuccgccaccaagggcgucacccuccugcugcccgagccgggguggaccuacccccggcucaguugccccggcuccacguuccagaaggcccugcugaucagcccccaccgcuucggggaggcgaagggcaauuccgccccgcucaucauccgggagcccuucaucgccugcggccccaacgagugcaagcacuuugcccugacccacuacgcggcccagcccgggggcuacuacaacgggacccgcggcgaucggaacaagcugcgccaccucaucagcgugaagcuggggaagaucccgaccguggagaacuccaucuuccauauggccgccuggagcggcuccgccugccacgacggcaaggaguggacguacaucggggucgauggccccgacaacaacgcgcugcucaaggugaaguacggggaggccuacaccgauaccuaccacucguacgccaacaagauccugcggacccaggaguccgccuguaacugcaucggcggcaacugcuaucugaugaucacggacgggagcgccagcggcguguccgagugccgcuuccucaagauccgggaggggcgcaucaucaaggagaucuuucccaccggccgggucaagcacaccgaggagugcacgugcggguucgcgagcaauaagaccaucgagugcgccugccgcgacaaccgguacaccgccaagcgccccuuugugaagcugaacguggagaccgacaccgccgagauccggcugaugugcacggacaccuaccucgauaccccgcgccccaacgacggcuccaucaccggccccugcgagagcgacggggauaagggcuccgggggcaucaagggcggguucguccaccagcggaugaaguccaagaucggccgcugguacagccggacgaugagcaagaccgagcgcauggggaugggccuguaugugaaguacgacggggaccccugggccgacuccgacgcgcuggccuuuagcggcgugauggucuccaugaaggagccggggugguacagcuucggcuucgagaucaaggauaagaagugcgacgugcccugcaucggcaucgagauggugcacgacgggggcaaggagaccuggcauuccgccgccaccgccaucuacugccucauggggagcggccagcugcugugggacacggucgcgggcguggacauggcccucuga

SEQ ID NO: 30393 - RNA, 1401 nt, Artificial Sequence
  derived and/or modified CDS sequence (AUadapt) from InfluenzaB__AHM01221__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaacuuucaggccgugaaccgcuccgccaccaagggcgugaccuuccuccugcccgagccggaguggaccuacccccggcugagcugccccggguccacguuccagaaggcccuccugaucagcccccaucgcuucggcgagaccaaggggaacuccgcgccgcugaucauccgggagcccuucaucgccugcggccccaacgagugcaagcacuuugcccucacccacuacgccgcgcagcccggcggguacuacaacggcacccgcggggaccggaacaagcugcgccaucugaucucggucaagcucggcaagaucccgacgguggagaacuccaucuuccacauggccgccuggagcggguccgccugccacgauggcaaggaguggaccuacaucggcguggacgggcccgacaacaacgcccugcugaaggucaaguacggcgaggcguacaccgauaccuaccacagcuacgccaacaagauccuccggacgcaggaguccgccugcaacuguaucgggggcaacugcuaccugaugaucaccgacggcagcgccucggggguguccgagugucgcuuccugaagauccgggagggccgcaucaucaaggagaucuuccccaccgggcgggugaagcacaccgaggagugcacgugcggcuucgccagcaauaagaccaucgagugcgcgugccgcgacaaccgguacaccgccaagcgccccuucgucaagcucaacguggagaccgauacggccgagauccggcugaugugcaccgacaccuaccuggacaccccgcgccccaacgacggguccaucacgggccccugcgagagugacggcgacaagggguccggcgggaucaagggcggguucgugcaccagcggaugaaguccaagaucggccgcugguacagccggaccaugucgaagaccgagcgcaugggcauggggcucuaugucaaguacgacggcgaccccugggccgacuccgacgcccuggcguucagcggggugaugguguccaugaaggagccgggcugguauagcuucggguucgagaucaaggacaagaagugcgacguccccugcaucggcaucgagauggugcaugacggcgggaaggagaccuggcacuccgccgccacggccaucuacugccugaugggcagcgggcagcuccugugggacaccgugaccggcgucgacauggcccuguga

SEQ ID NO: 30394 - RNA, 1401 nt, Artificial Sequence; identical to SEQ ID NO: 28675
  derived and/or modified CDS sequence (AUadapt) from InfluenzaB__AHM01232__NA

SEQ ID NO: 30395 - RNA, 1401 nt, Artificial Sequence; identical to SEQ ID NO: 28678
  derived and/or modified CDS sequence (AUadapt) from InfluenzaB__AHM01243__NA

SEQ ID NO: 30396 - RNA, 1401 nt, Artificial Sequence
  derived and/or modified CDS sequence (AUadapt) from InfluenzaB__AHM01254__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccgcuccgccaccaagggcgucacccuccugcugcccgagccggaguggaccuacccccggcucagcugccccggguccacguuccagaaggcccugcugaucagcccccaucgcuucggcgagaccaaggggaacuccgcgccgcucaucauccgggagcccuucaucgccugcggccccaacgagugcaagcacuuugcccugacccacuacgccgcgcagcccggcggguacuacaacggcacccgcggggaccggaauaagcugcgccaccucaucucggugaagcugggcaagaucccgacgguggagaacuccaucuuccacauggccgccuggagcggguccgccugucacgacggcaaggaguggaccuacaucggcgucgacgggcccgacaacaacgcccugcucaaggugaaguauggcgaggcguacaccgacaccuaccacagcuacgccaauaagauccugcggacgcaggaguccgccugcaacugcaucgggggcaacugcuaccugaugaucaccgauggcagcgccucggggguguccgagugccgcuuccucaagauccgggagggccgcaucaucaaggagaucuuccccaccgggcgggucaagcacaccgaggaguguacgugcggcuucgccagcaacaagaccaucgagugcgcgugccgcgacaaucgguacaccgccaagcgccccuucgugaagcugaacguggagaccgacacggccgagauccggcugaugugcaccgacaccuaucucgacaccccgcgccccaacgacggguccaucacgggccccugcgagagcgacggcgauaagggguccggcgggaucaagggcggguucguccaccagcggaugaaguccaagaucggccgcugguacagccggaccaugucgaagaccgagcgcaugggcauggggcuguacgugaaguacgauggcgaccccugggccgacuccgacgcccugguguucagcggggucaugguguccaugaaggagccgggcugguacaguuucggguucgagaucaaggacaagaagugcgacgugcccugcaucggcaucgagaugguccaugacggcgggaaggagaccuggcacuccgcggccacggccaucuacugccucaugggcagcgggcagcugcugugggacaccgugaccggcguggacauggcccucuga

SEQ ID NO: 30397 - RNA, 1401 nt, Artificial Sequence
  derived and/or modified CDS sequence (AUadapt) from InfluenzaB__AHM01265__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccagcaacgugcaggccgugaaccgcuccgccaccaagggcgucacccuccugcugcccgagccggaguggaccuacccccggcucagcugucccggguccacguuccagaaggcccugcugaucucgccccaccgcuucggcgagaccaaggggaacuccgcgccgcucaucauccgggagcccuuuaucgccugcggccccaacgagugcaagcacuucgcccugacccacuaugccgcgcagcccggcggguacuacaacggcacccgcggggaccggaacaagcugcgccaucucaucagcgugaagcugggcaagaucccgacgguggagaacuccaucuuccacauggccgccuggagcggguccgccugucacgacggcaaggaguggaccuacaucggcgucgacgggcccgacaauaacgcccugcucaaggugaaguacggcgaggcguacaccgacaccuaccauagcuacgccaacaagauccugcggacgcaggaguccgccugcaacugcaucgggggcaauugcuaccugaugaucaccgacggcagcgccagcgggguguccgagugucgcuuccucaagauccgggagggccgcaucaucaaggagaucuuccccaccgggcgggucaagcacaccgaggagugcacgugcggcuuugccucgaacaagaccaucgagugcgcgugccgcgacaaucgguacaccgccaagcgccccuucgugaagcugaacguggagaccgacacggccgagauccggcugaugugcaccgauaccuaccucgacaccccgcgccccaacgacggguccaucacgggccccugcgagagcgauggcgacgagggguccggcgggaucaagggcggguucguccaccagcggaugaaguccaagaucggccgcugguacagccggaccaugaguaagaccgagcgcaugggcauggggcuguacgugaaguacgacggcgaccccugggccgacuccgaugcccuggcguucagcggggugauggucuccaugaaggagccgggcugguacagcuucggguuugagaucaaggacaagaagugcgacgugcccugcaucggcaucgagauggugcacgauggcgggaaggagaccuggcacuccgccgccacggccaucuacugccucaugggcagcgggcggcugcugugggacaccgucaccggcguggacauggcccucuga

SEQ ID NO: 30398 - RNA, 1401 nt, Artificial Sequence
  derived and/or modified CDS sequence (AUadapt) from InfluenzaB__AHM01276__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcacgaaugcgagcaacgugcaggccgugaaccgcuccgccgccaagggcgucacccuccugcugcccgagcccgaguggaccuacccgcggcucagcugucccggguccaccuuccagaaggcccugcugaucucgccccaccgcuucggcgagaucaaggggaacuccgcgccccucaucauccgggagccguucaucgccuguggccccacggagugcaagcacuucgcccugacccacuacgccgcgcagcccggcggguauuacaacggcacccgcgaggaccggaacaagcugcgccaccucaucagugugaagcuggggaagauccccaccguggagaacuccaucuuccacauggccgccuggagcggcuccgccugccaugacgggaaggaguggacguacaucggcgucgacggcccggacagcaacgcccugcucaagaucaaguauggggaggcguacaccgacaccuaccacuccuacgccaagaauauccugcggacccaggagagcgccugcaacugcaucggcggggacuguuaccugaugaucacggacggccccgccagcggcguguccgagugccgcuuccucaagauccgggaggggcgcaucaucaaggagaucuuucccaccggccgggugaagcacaccgaggagugcacgugcggguucgccucgaacaagaccaucgagugugcgugccgcgacaaccgguacaccgccaagcgccccuucgucaagcugaauguggagaccgacaccgccgagauccggcugaugugcacggagaccuaccucgacaccccgcgccccaacgauggcuccaucaccgggcccugcgagagcgacggcgacaagggcuccgggggcaucaagggcggguucgugcaucagcggauggccagcaagaucgggcgcugguacucccggacgaugagcaagaccaagcgcaugggcaugggccuguacgucaaguacgacggggaucccuggaccgacuccgaggcccuggcgcucagcggcgugaugguguccauggaggagccggggugguacagcuucggcuuugagaucaaggacaagaagugcgacguccccugcaucgggaucgagauggugcacgauggcggcaagaccacguggcacuccgccgccaccgccaucuacugccugauggggagcggccagcugcucugggacaccgugaccggggucgacauggcccuguga

SEQ ID NO: 30399 - RNA, 1401 nt, Artificial Sequence; identical to SEQ ID NO: 30383
  derived and/or modified CDS sequence (AUadapt) from InfluenzaB__AHM01287__NA

SEQ ID NO: 30400 - RNA, 1401 nt, Artificial Sequence; identical to SEQ ID NO: 30383
  derived and/or modified CDS sequence (AUadapt) from InfluenzaB__AHM01298__NA

SEQ ID NO: 30401 - RNA, 1401 nt, Artificial Sequence; identical to SEQ ID NO: 30398
  derived and/or modified CDS sequence (AUadapt) from InfluenzaB__AHM01309__NA

SEQ ID NO: 30402 - RNA, 1401 nt, Artificial Sequence; identical to SEQ ID NO: 28678
  derived and/or modified CDS sequence (AUadapt) from InfluenzaB__AHM01320__NA

SEQ ID NO: 30403 - RNA, 1401 nt, Artificial Sequence; identical to SEQ ID NO: 30383
  derived and/or modified CDS sequence (AUadapt) from InfluenzaB__AHM01331__NA

SEQ ID NO: 30404 - RNA, 1401 nt, Artificial Sequence; identical to SEQ ID NO: 28678
  derived and/or modified CDS sequence (AUadapt) from InfluenzaB__AHM01342__NA

SEQ ID NO: 30405 - RNA, 1401 nt, Artificial Sequence
  derived and/or modified CDS sequence (AUadapt) from InfluenzaB__AHM01353__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccgggguggaccuacccccggcucagcugccccggcuccacguuucagaaggcccugcugaucagcccccaccgcuucggggagaccaagggcaacuccgcgccgcucaucauccgggagcccuucaucgccugcggccccaaugagugcaagcacuucgcccugacccacuacgccgcgcagcccgggggcuauuacaacgggacccgcggcgaccggaacaagcugcgccaccucaucagcgugaagcuggggaagaucccgacgguggagaauuccaucuuccacauggccgccuggagcggcuccgccugccacgauggcaaggaguggaccuacaucggggucgacggccccgacaacaacgcccugcucaaggugaaguacggggaggcguauaccgacaccuaccacucguacgccaauaagauccugcggacgcaggaguccgccugcaacugcaucggcggcaacugcuaccugaugaucaccgaugggagcgccagcggcguguccgagugccgcuuccucaagauccgggaggggcgcaucaucaaggagaucuuccccaccggccgggucaagcauaccgaggagugcacgugcggguucgccagcaacaagaccaucgagugcgcgugucgcgacaaccgguacaccgccaagcgccccuucgugaagcugaacguggagaccgauacggccgagauccggcugaugugcaccgacaccuaccucgacaccccgcgccccaacgacggcuccaucacgggccccugugagagcgacggggacaagggcuccgggggcaucaagggcggguucguccaccagcggaugaaguccaagaucggccgcugguauucgcggaccaugagcaagaccgagcgcauggggaugggccuguacgugaaguacgacggggaccccugggccgauuccgacgcccuggcguucagcggcgugauggucuccaugaaggagccggggugguacagcuuuggcuucgagaucaaggacaagaagugcgacgugcccugcaucggcaucgagauggugcacgaugggggcaaggagaccuggcacuccgccgccacggccaucuacugccucauggggagcggccagcugcugugggacaccgucaccggcguggacauggcccucuga

SEQ ID NO: 30406 - RNA, 1401 nt, Artificial Sequence
  derived and/or modified CDS sequence (AUadapt) from InfluenzaB__AHM01364__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuucagaaggcccugcugaucagcccccaccgcuucggcgagaccaaggggaacuccgcgccgcucaucauccgggagcccuucaucgccugcggccccaaugagugcaagcacuucgcccugacccacuacgccgcgcagcccggcggguauuacaacggcacccgcggggaccggaacaagcugcgccaccucaucagcgugaagcugggcaagaucccgacgguggagaauuccaucuuccacauggccgccuggagcggguccgccugccacgauggcaaggaguggaccuacaucggcgucgacgggcccgacaacaacgcccugcucaaggugaaguacggcgaggcguauaccgacaccuaccacucguacgccaauaagauccugcggacgcaggaguccgccugcaacugcaucgggggcaacugcuaccugaugaucaccgauggcagcgccagcgggguguccgagugccgcuuccucaagauccgggagggccgcaucaucaaggagaucuuccccaccgggcgggucaagcauaccgaggagugcacgugcggcuucgccagcaacaagaccaucgagugcgcgugucgcgacaaccgguacaccgccaagcgccccuucgugaagcugaacguggagaccgauacggccgagauccggcugaugugcaccgacaccuaccucgacaccccgcgccccaacgacggguccaucacgggccccugugagagcgacggcgacgagggguccggcgggaucaagggcggguucguccaccagcggaugaaguccaagaucggccgcugguauucgcggaccaugagcaagaccgagcgcaugggcauggggcuguacgugaaguacgacggcgaccccugggccgauuccgacgcccuggcguucagcggggugauggucuccaugaaggagccgggcugguacagcuuuggguucgagaucaaggacaagaagugcgacgugcccugcaucggcaucgagauggugcacgauggcgggaaggagaccuggcacuccgccgccacggccaucuacugccucaugggcagcgggcagcugcugugggacaccgucaccggcguggacauggcccucuga

SEQ ID NO: 30407 - RNA, 1401 nt, Artificial Sequence; identical to SEQ ID NO: 30398
  derived and/or modified CDS sequence (AUadapt) from InfluenzaB__AHM01375__NA

SEQ ID NO: 30408 - RNA, 1401 nt, Artificial Sequence; identical to SEQ ID NO: 30398
  derived and/or modified CDS sequence (AUadapt) from InfluenzaB__AHM01386__NA

SEQ ID NO: 30409 - RNA, 1401 nt, Artificial Sequence; identical to SEQ ID NO: 28678
  derived and/or modified CDS sequence (AUadapt) from InfluenzaB__AHM01397__NA

SEQ ID NO: 30410 - RNA, 1401 nt, Artificial Sequence; identical to SEQ ID NO: 28678
  derived and/or modified CDS sequence (AUadapt) from InfluenzaB__AHM01408__NA

SEQ ID NO: 30411 - RNA, 1401 nt, Artificial Sequence; identical to SEQ ID NO: 28678
  derived and/or modified CDS sequence (AUadapt) from InfluenzaB__AHM01419__NA

SEQ ID NO: 30412 - RNA, 1401 nt, Artificial Sequence
  derived and/or modified CDS sequence (AUadapt) from InfluenzaB__AHM01430__NA
augcugcccaguaccauccagacccucacgcuguuccugaccuccggcggggugcuccugagccuguacgucuccgccagccucuccuaucugcuguacagcgacauccuccugaaguucuccccgaccgagaucaccgcccccacgaugccccuggacugugcgaacgccagcaacgugcaggccgugaaccgcuccgccaccaagggcgucacccuccugcugcccgagccggaguggaccuacccccggcucaguugccccggguccacguuccagaaggcccugcugaucucgccccaccgcuucggcgagaccaaggggaauuccgcgccgcucaucauccgggagcccuucaucgccugcggccccaacgagugcaagcacuuugcccugacccacuacgccgcgcagcccggcggguacuacaacggcacccgcggggaucggaacaagcugcgccaccucaucagcgugaagcugggcaagaucccgacgguggagaacuccaucuuccauauggccgccuggagcggguccgccugccacgacggcaaggaguggaccuacaucggcgucgaugggcccgacaacaacgcccugcucaaggugaaguacggcgaggcguacaccgauaccuaccacagcuacgccaacaagauccugcggacgcaggaguccgccuguaacugcaucgggggcaacugcuaucugaugaucaccgacggcagcgccagcgggguguccgagugccgcuuccucaagauccgggagggccgcaucaucaaggagaucuuucccaccgggcgggucaagcacaccgaggagugcacgugcggcuucgccucgaauaagaccaucgagugcgcgugccgcgacaaccgguacaccgccaagcgccccuuugugaagcugaacguggagaccgacacggccgagauccggcugaugugcaccgacaccuaccucgauaccccgcgccccaacgacggguccaucacgggccccugcgagagcgacggcgaugagggguccggcgggaucaagggcggguucguccaccagcggaugaaguccaagaucggccgcugguacagccggaccaugagcaagaccgagcgcaugggcauggggcuguaugugaaguacgacggcgaccccugggccgacuccgacgcccuggcguuuagcggggugauggucuccaugaaggagccgggcugguacagcuucggguucgagaucaaggauaagaagugcgacgugcccugcaucggcaucgagauggugcacgacggcgggaaggagaccuggcauuccgccgccacggccaucuacugccucaugggcagcgggcggcugcugugggacaccgccaccggcgucgacauggcgcucuga

SEQ ID NO: 30413 - RNA, 1401 nt, Artificial Sequence
  derived and/or modified CDS sequence (AUadapt) from InfluenzaB__AHM01441__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgacgaugccccuggacugugcgaacgccagcaacgugcaggccgugaaccgcuccgccgccaagggcgucacccuccugcugcccgagcccgaguggaccuacccgcggcucaguugccccggguccaccuuccagaaggcgcugcugaucagcccccaccgcuuuggcgagaucaaggggaacuccgcgccccucaucauccgggagccguucaucgccugcggccccacggagugcaagcacuuugcccugacccacuacgccgcccagcccggcggguacuacaacggcacccgcgaggaucggaacaagcugcgccaccucaucagcgugaagcuggggaagauccccaccguggagaacuccaucuuucacauggccgccuggagcggcuccgccugccacgacgggaaggaguggacguauaucggcgucgacggcccggacucgaacgcgcugcucaagaucaaguacggggaggccuauaccgacaccuaccacuccuacgccaagaauauccugcggacccaggagagcgccugcaacugcaucggcggggacuguuaccugaugaucacggacggccccgccagcggcguguccgagugccgcuuccucaagauccgggaggggcgcaucaucaaggagaucuuucccaccggccgggugaagcacaccgaggagugcacgugcggguucgcgaguaacaagaccaucgagugcgccugccgcgacaaccgguauaccgccaagcgccccuucgucaagcugaacguggagaccgacaccgccgagauccggcugaugugcacggagaccuaccucgauaccccgcgccccaacgacggcuccaucaccgggcccugcgagagcgauggcgacaagggcuccgggggcaucaagggcggguucgugcaccagcggauggccagcaagaucgggcgcugguacucccggacgaugaguaagaccaagcgcaugggcaugggccuguacgucaaguacgacggggaccccuggaccgacuccgaggcgcuggcccucaguggcgugaugguguccauggaggagccggggugguacagcuucggcuucgagaucaaggauaagaagugcgacguccccugcaucgggaucgagauggugcacgacggcggcaagaccacguggcauuccgccgccaccgccaucuacugccugauggggagcggccagcugcucugggacaccgugaccggggucgacauggcgcuguga

SEQ ID NO: 30414 - RNA, 1401 nt, Artificial Sequence; identical to SEQ ID NO: 28678
  derived and/or modified CDS sequence (AUadapt) from InfluenzaB__AHM01463__NA

SEQ ID NO: 30415 - RNA, 1401 nt, Artificial Sequence
  derived and/or modified CDS sequence (AUadapt) from InfluenzaB__AHM01474__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcaucaacgcgaguaacgugcaggccgugaaccgcuccgccgccaagggcgucacgcuccugcugcccgagcccgaguggaccuacccgcggcucagcugccccggguccaccuuucagaaggcccugcugaucucgccccaccgcuucggcgagaucaaggggaacuccgcgccccucaucauccgggagccguucaucgccugcggccccaccgaguguaagcacuucgcccugacgcacuacgccgcgcagcccggcggguacuacaauggcacccgcgaggaccggaacaagcugcgccaccucaucagcgugaagcuggggaagauccccaccguggagaacuccaucuuucacauggccgccuggagcggcuccgccugccacgacgggaaggaguggaccuacaucggcgucgauggcccggacagcaacgcccugcucaagaucaaguacggggaggcguacacggauaccuaccacuccuacgccaagaacauccugcggacccaggagagcgccugcaauugcaucggcggggacugcuaccugaugaucaccgacggccccgccagcggcguguccgagugucgcuuccucaagauccgggaggggcgcaucaucaaggagaucuuccccacgggccgggugaagcacaccgaggagugcacgugcggguuugccucgaacaagaccaucgagugcgcgugccgcgacaaccgguauaccgccaagcgccccuucgucaagcugaacguggagaccgacaccgccgagauccggcugaugugcaccgagacguaccucgauaccccgcgccccaacgacggcuccaucaccgggcccugcgagagcgacggcgacaagggcuccgggggcaucaagggcggguuugugcaccagcggauggccagcaagaucgggcgcugguacucccggaccaugagcaagacgaagcgcaugggcaugggccuguacgucaaguacgauggggaccccuggaccgacuccgaggcccuggcgcucagcggcgugaugguguccauggaggagccggggugguacagcuuuggcuucgagaucaaggacaagaagugcgacguccccugcaucgggaucgagauggugcacgauggcggcaagaccaccuggcacuccgccgccacggccaucuacugccugauggggagcggccagcugcucugggacaccgugaccggggucgacauggcccuguga

SEQ ID NO: 30416 - RNA, 1401 nt, Artificial Sequence
  derived and/or modified CDS sequence (AUadapt) from InfluenzaB__AHM01485__NA
augcugcccaguaccauccagacccucacgcuguuccugaccuccggcggggugcuccugagccuguacgucuccgccagccucuccuaucugcuguacagcgacauccuccugaaguucuccccgaccgagaucaccgcccccaucaugccccuggacuguacgaacgcgagcaacgugcaggccgugaaccgcuccgccgccaagggcgucacccuccugcugcccgagccggaguggaccuacccccggcucaguugccccggguccaccuuccagaaggcccugcugaucagcccccaccgcuucggcgagaucaaggggaauuccgcgccgcucaucauccgggagcccuucaucgccugcggccccacggagugcaagcacuucgcccugacccauuacgccgcgcagcccggcggguacuacaacggcacccgcgaggaccggaauaagcugcgccaccucaucagcgugaagcuggggaagaucccgaccguggagaacuccaucuuccacauggccgccuggaguggcuccgccugccacgacgggaaggaguggacguacaucggcgucgacggccccgauucgaacgcccugcucaagaucaaguacggggaggcguacaccgacaccuaucacuccuacgccaagaacauccugcggacccaggagagcgccugcaauugcaucggcggggacugcuaccugaugaucacggacggccccgccaguggcguguccgagugccgcuuccucaagauccgggaggggcgcaucaucaaggagaucuuccccaccggccgggugaagcacaccgaggagugcacguguggguucgccagcaacaagaccaucgagugcgcgugccgcgauaaccgguacaccgccaagcgcccguucgucaagcugaacguggagaccgacaccgccgagauccggcugauguguacggagaccuaccucgacacgccccgccccaacgacggcuccaucaccgggcccugcgagagugacggcgacaagggcuccgggggcaucaagggcggguucgugcaccagcggauggccagcaagaucgggcgcugguauucccggaccaugagcaagaccaagcgcaugggcaugggccuguacgucaaguacgacggggacccguggaccgauuccgaggcccuggcgcucagcggcgugaugguguccauggaggagcccgggugguacagcuucggcuucgagaucaaggauaagaagugcgacguccccugcaucgggaucgagauggugcacgacggcggcaagaccacguggcauuccgccgccaccgccaucuacugccugauggggagcggccagcugcucugggacaccgugaccggggucgacauggcccuguga

SEQ ID NO: 30417 - RNA, 1401 nt, Artificial Sequence; identical to SEQ ID NO: 30398
  derived and/or modified CDS sequence (AUadapt) from InfluenzaB__AHM01496__NA

SEQ ID NO: 30418 - RNA, 1401 nt, Artificial Sequence
  derived and/or modified CDS sequence (AUadapt) from InfluenzaB__AHM01507__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgaucaugccccuggacugugcgaacgccagcaacgugcaggccgugaaccgcuccgccgccaagggcgucacgcuccugcugcccgagcccgaguggaccuacccgcggcucaguugccccggguccaccuuccagaaggcgcugcugaucagcccccaccgcuuuggcgagaucaaggggaacuccgcgccccucaucgugcgggagccguucaucgccugcggccccaccgagugcaagcacuuugcccugacgcacuacgccgcccagcccggcggguacuacaacggcacccgcgaggaucggaacaagcugcgccaccucaucagcgugaagcuggggaagauccccaccgucgagaacuccaucuuucacauggccgccuggagcggcuccgccugccacgacgggaaggaguggaccuauaucggcguggacggcccggacagcaacgcgcugcucaagaucaaguacggggaggccuauacggacaccuaccacuccuacgccaagaauauccugcggacccaggagagcgccugcaacugcaucggcggggacuguuaccugaugaucaccgacggccccgccagcggcguguccgagugccgcuuccucaagauccgggaggggcgcaucaucaaggagaucuuucccacgggccgggucaagcacaccgaggagugcacgugcggguucgcgaguaacaagaccaucgagugcgccugccgcgacaaccgguauaccgccaagcgccccuucgugaagcugaacguggagaccgacaccgccgagauccggcugaugugcaccgagacguaccucgauaccccgcgccccaacgacggcuccaucaccgggcccugcgagagcgauggcgacaagggcuccgggggcaucaagggcggguucguccaccagcggauggccagcaagaucgggcgcugguacucccggaccaugaguaagacgaagcgcaugggcaugggccuguacgugaaguacgacggggaccccuggaccgacuccgaggcgcuggcccucaguggcgugauggucuccaucgaggagccggggugguacagcuucggcuucgagaucaaggauaagaagugcgacgugcccugcaucgggaucgagauggugcacgacggcggcaagaccaccuggcauuccgccgccacggccaucuacugccugauggggagcggccagcugcucugggacaccgucaccgggguggacauggcgcuguga

SEQ ID NO: 30419 - RNA, 1401 nt, Artificial Sequence; identical to SEQ ID NO: 30398
  derived and/or modified CDS sequence (AUadapt) from InfluenzaB__AHM01518__NA

SEQ ID NO: 30420 - RNA, 1401 nt, Artificial Sequence
  derived and/or modified CDS sequence (AUadapt) from InfluenzaB__AHM01529__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgaucaugccccuggacuguacgaacgcgagcaacgugcaggccgugaaccgcuccgccgccaagggcgucacccuccugcugcccgagcccgaguggaccuacccgcggcucaguugccccggguccaccuuccagaaggcccugcugaucucgccccaccgcuucggcgagaucaaggggaauuccgcgccccucaucauccgggagccguucaucgccugcggccccacggagugcaagcacuucgcccugacccauuacgccgcgcagcccggcggguacuacaacggcacccgcgaggaccggaauaagcugcgccaccucaucagcgugaagcuggggaagauccccaccguggagaacuccaucuuccacauggccgccuggaguggcuccgccugccacgacgggaaggaguggacguacaucggcgucgacggcccggauagcaacgcccugcucaagaucaaguacggggaggcguacaccgacaccuaucacuccuacgccaagaacauccugcggacccaggagagcgccugcaauugcaucggcggggacugcuaccugaugaucacggauggccccgccagcggcguguccgagugccgcuuccucaagauccgggaggggcgcaucaucaaggagauccugcccaccggccgggugaagcacaccgaggagugcacguguggguucgccucgaacaagaccaucgagugcgcgugccgcgauaaccgguacaccgccaagcgccccuucgucaagcugaacguggagaccgacaccgccgagauccggcucauguguacggagaccuaccuggacaccccgcgccccaacgacggcuccaucaccgggcccugcgagagugacggcgacaagggcuccgggggcaucaagggcggguucgugcaccagcggauggccagcaagaucgggcgcugguauucccggacgaugagcaagaccaagcgcaugggcaugggccuguacgucaaguacgacggggaccccuggaccgauuccgaggcccucgcgcugagcggcgugaugguguccauggaggagccggggugguacagcuucggcuucgagaucaaggauaagaagugcgacguccccugcaucgggaucgagauggugcacgacggcggcaagaccacguggcauuccgccgccaccgccaucuacugccugauggggagcggccagcuccugugggacaccgugaccggggucgacauggcccuguga

SEQ ID NO: 30421 - RNA, 1401 nt, Artificial Sequence; identical to SEQ ID NO: 28675
  derived and/or modified CDS sequence (AUadapt) from InfluenzaB__AHM01540__NA

SEQ ID NO: 30422 - RNA, 1401 nt, Artificial Sequence; identical to SEQ ID NO: 30398
  derived and/or modified CDS sequence (AUadapt) from InfluenzaB__AHM01551__NA

SEQ ID NO: 30423 - RNA, 1401 nt, Artificial Sequence; identical to SEQ ID NO: 30398
  derived and/or modified CDS sequence (AUadapt) from InfluenzaB__AHM01562__NA

SEQ ID NO: 30424 - RNA, 1401 nt, Artificial Sequence; identical to SEQ ID NO: 28905
  derived and/or modified CDS sequence (AUadapt) from InfluenzaB__AHZ13597__NA

SEQ ID NO: 30425 - RNA, 1404 nt, Artificial Sequence
  derived and/or modified CDS sequence (AUadapt) from InfluenzaB__AHZ36701__NA
augcugcccaguaccauccagaugcucacccuguuccugacguccggcggggugcuccugagccuguacgucuccgccagccucuccuaccugcuguacucggacauccuccugaaguuuuccccgaccgagaucaccgcccccaccaugccccuggacugcgcgaacgccagcaacgugcacgccgugaaccgcuccgccacgaagggcgucaccuuccuccugcugcccgagccggaguggaccuauccccggcucagcugccccggguccaccuuccagaaggcccugcugaucucgccccaccgcuucggcgagacgaaggggaacuccgcgccgcucaucauccgggagcccuucaucgccuguggccccaacgagugcaagcacuucgcccugacccacuacgccgcgcagcccggcggguacuacaauggcacccgcggggaccggaacaagcugcgccaccucaucagcgugaagcugggcaagaucccgaccguggagaacuccaucuuccacauggccgccuggagcggguccgccugucacgacggcaaggaguggacguacaucggcgucgacgggcccgacaacaacgcccugcucaagaucaaguacggcgaggcguauaccgacaccuaccacucguacgccaacaacauccugcggacccaggaguccgccugcaauugcaucgggggcaacugcuaccugaugaucacggacggcagcgccagcgggguguccgagugccgcuuucucaagauccggaagggccgcaucaucaaggagaucuuccccaccgggcgggugaagcacaccgaggagugcacgugcggcuucgccucgaacaagaccaucgagugcgcgugucgcgacaacuccuacaccgccaagcggcccuucgucaagcugaacguggagaccgacaccgccgagauccgccugaugugcacggacaccuaucucgacaccccgcggcccgacgacgggagcaucaccggccccugcgaguccaacggcgacaaggggagcggcgggaucaagggcggguuugugcaccagcgcauggccuccaagaucggccggugguacucgcgcacgauguccaagaccgagcggaugggcauggggcuguacgucaaguacgacggcgaccccuggaccgacagugacgcccuggcguuccgcggggugaugguguccaugaaggagccgggcugguacagcuucggguucgagaucaaggacaagaagugcgauguccccugcaucggcaucgagauggugcacgacggcgggaaggagaccuggcacuccgccgccacggccaucuacugccucaugggcagcgggcagcugcugugggacaccgugaccggcgucgacauggcccucuga

SEQ ID NO: 30426 - RNA, 1404 nt, Artificial Sequence
  derived and/or modified CDS sequence (AUadapt) from InfluenzaB__AHZ36756__NA
augcugcccaguaccauccagaugcucacccuguuccugacguccggcggggugcuccugagccuguacgucuccgccagccucuccuaccugcuguacucggauauccuccugaaguucuccccgaccgagaucaccgcccccaccaugccccuggacugcgcgaacgccagcaacgugcacgccgugaaucgcuccgccacgaagggcgucaccuuccuccugcugcccgagccggaguggaccuacccccggcucagcugccccggguccaccuuccagaaggcccugcugaucagcccccaccgcuucggcgagacgaaggggaauuccgcgccgcucaucauccgggagcccuucaucgccugcggccccaacgagugcaagcacuucgcccugacccacuaugccgcgcagcccggcggguacuacaacggcacccgcggggaccggaacaagcugcgccaccucaucucggugaagcugggcaagaucccgaccguggagaacuccaucuuucacauggccgccuggagcggguccgccugccacgacggcaaggaguggacguacaucggcgucgacgggcccgauaacaacgcccugcucaagaucaaguacggcgaggcguacaccgacaccuaccacagcuaugccaacaacauccugcggacccaggaguccgccugcaacugcaucgggggcaacugcuaucugaugaucacggacggcagcgccucggggguguccgagugccgcuuccucaagauccgggagggccgcaucaucaaggagaucuuccccaccgggcgggugaagcacaccgaggagugcacguguggcuucgccagcaacaagaccaucgagugcgcgugccgcgacaacuccuauaccgccaagcggcccuucgucaagcugaacguggagaccgacaccgccgagauccgccugaugugcacggacaccuaccucgacaccccgcggcccgacgaugggagcaucaccggccccugcgaguccaacggcgacaaggggagcggcgggaucaagggcggguucgugcaccagcgcauggccuccaagaucggccggugguauucgcgcacgauguccaagaccgagcggaugggcauggggcuguacgucaaguacgacggcgaccccuggaccgacagcgacgcccuggcguuucgcggggugaugguguccaugaaggagccgggcugguacagcuucggguucgagaucaaggacaagaagugcgacguccccuguaucggcaucgagauggugcacgacggcgggaaggagaccuggcacuccgccgccacggccaucuacugccucaugggcagcgggcagcugcugugggacaccgugaccggcgucgacauggcccucuga

SEQ ID NO: 30427 - RNA, 1401 nt, Artificial Sequence
  derived and/or modified CDS sequence (AUadapt) from InfluenzaB__AHZ36767__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgcgcccccuggacugcgcgaaugccucgaacgugcaggccgugaaccgguccgccaccaagggcgucacccuccugcugcccgagccggaguggaccuacccccgccucagcugucccggguccacguuccagaaggcccugcugaucagcccccaccgguucggcgagaccaaggggaacuccgcgccgcucaucauccgcgagcccuuuaucgccugcggccccaacgagugcaagcacuucgcccugacccacuaugccgcgcagcccggcggguacuacaacggcacccgcggggaccggaacaagcugcggcaucucaucagcgugaagcugggcaagaucccgacgguggagaacuccaucuuccacauggccgccuggagcggguccgccugucacgacggcaaggaguggaccuacaucggcgucgacgggcccgacaauaacgcccugcucaaggugaaguacggcgaggcguacaccgacaccuaccauucguacgccaacaagauccugcgcacgcaggaguccgccugcaacugcaucgggggcaauugcuaccugaugaucaccgacggcagcgccagcgggguguccgagugucgguuccucaagauccgcgagggccggaucaucaaggagaucuuccccaccgggcgcgucaagcacaccgaggagugcacgugcggcuuugccagcaacaagaccaucgagugcgcgugccgggacaaucgcuacaccgccaagcggcccuucgugaagcugaacguggagaccgacacggccgagauccgccugaugugcaccgauaccuaccucgacaccccgcggcccaacgacggguccaucacgggccccugcgagagcgauggcgacaagggguccggcgggaucaagggcggguucguccaccagcgcaugaaguccaagaucggccggugguacucgcgcaccaugaguaagaccgagcggaugggcauggggcuguacgugaaguacgacggcgaccccugggccgacuccgaugcccuggcguucagcggggugauggucuccaugaaggagccgggcugguacagcuucggguuugagaucaaggacaagaagugcgacgugcccugcaucggcaucgagauggugcacgauggcgggaaggagaccuggcacuccgccgccacggccaucuacugccucaugggcagcgggcagcugcugugggacaccgucaccggcguggacauggcccucuga

SEQ ID NO: 30428 - RNA, 1401 nt, Artificial Sequence
  derived and/or modified CDS sequence (AUadapt) from InfluenzaB__AHZ36778__NA
augcugcccaguaccauccagacccucacgcuguuccugaccuccggcggggugcuccugagccuguacgucuccgccucgcucuccuaccugcuguacagcgauauccuccugaaguucccguccaccgagaucaccgcccccacgaugccccuggacugcgcgaacgccucgaacgugcaggccgugaaccgcuccgccaccaagggcgucacccuccugcugcccgagccggaguggaccuacccccggcucaguugccccggguccacguuccagaaggcccugcugaucagcccccaccgcuucggcgagaccaaggggaacuccgcgccgcucaucauccgggagcccuucaucgccuguggccccaaggagugcaagcacuucgcccugacccacuacgccgcgcagcccggcggguacuacaacggcacccgcggggaucggaacaagcugcgccaccucaucucggugaagcugggcaagaucccgacgguggagaacuccaucuuccacauggccgccuggagcggguccgccugccaugacggcaaggaguggaccuacaucggcgucgacgggcccgacaacaacgcccugcucaagaucaaguacggcgaggcguauaccgacaccuaccacucguacgccaacaacauccugcggacgcaggaguccgccugcaauugcaucgggggcaacugcuaccugaugaucaccgacggcagcgccucggggguguccgagugccgcuuucucaagauccgggagggccgcaucaucaaggagaucuuccccaccgggcggauccagcacaccgaggagugcacgugcggcuucgccagcaacaagaccaucgagugugcgugccgcgacaacuccuacaccgccaagcggcccuucgugaagcugaacgucgagaccgacacggccgagauccgccugaugugcaccaagaccuaucucgacaccccgcggcccgaggacgggagcaucacgggccccugcgaguccaacggcgggaagggcucggggggcaucaagggcggguucgugcaccagcgcauggccuccaagaucggccggugguauagccgcaccauguccaagaccgagcggaaggggaugggccuguacgugaaguacaacggggaccccugggccgacucggaugcgcuggucuucuccggcgugaugaucagcauggaggagccggggugguacuccuucggcuucgagaucaaggacaagaagugcgacgugcccuguaucggcaucgagaugguccacgacgggggcaaggagaccuggcacagcgccgccacggccaucuacugccucaugggguccggccagcugcugugggacaccgugaccggcgugaacaugacccucuga

SEQ ID NO: 30429 - RNA, 1401 nt, Artificial Sequence
  derived and/or modified CDS sequence (AUadapt) from InfluenzaB__AHZ36789__NA
augcugcccaguaccauccagacccucacgcuguuccugaccuccggcggggugcuccugagccuguacgucuccgccagccucuccuaccugcuguauucggacauccuccugaaguucuccccgaccgagaucaccgcccagacgaugccccuggacugcgcgaacgccaguaacgugcaggccgugaaccgcuccgccaccaagggcgucacccuccugccgcccgagcccgaguggaccuacccccggcugagcugccccggguccacguuccagaaggcccuccugaucaguccccaccgcuucggcgagaccaaggggaacuccgcgccgcugaucauccgggagcccuucaucgccugcggccccaacgaguguaagcacuucgcccucacccacuacgccgcgcagcccggcggguacuacaauggcacccgcggggaccggaacaagcugcgccaccugaucagcgugaagcucggcaagaucccgacgguggagaacuccaucuuccauauggccgccuggagcggguccgccugccacgacggcaaggaguggaccuacaucggcgucgacgggcccgauaacaacgcccugcugaaggugaaguacggcgaggcguacaccgacaccuaccauucguacgccaacaagauccuccggacgcaggaguccgccugcaacugcaucgggggcaauugcuaccugaugaucaccgacggcagcgccagcgggguguccgagugucgcuuccugaagauccgggagggccgcaucaucaaggagaucuuccccaccgggcgggucaagcacaccgaggagugcacgugcggcuucgccaguaacaagaccaucgagugcgcgugccgcgacaaccgguacaccgccaagcgccccuuugugaagcucaacguggagaccgacacggccgagauccggcugaugugcaccgacaccuaccuggacaccccgcgccccaaugacggguccaucacgggccccugcgagagcgacggcgacaagggguccggcgggaucaagggcggguucguccaucagcggaugaaguccaagaucggccgcugguacagccggaccaugucgaagaccgagcgcaugggcauggggcucuacgugaaguacgacggcgaucccugggccgacuccgacgcccuggcguucagcggggugauggucuccaugaaggagccgggcugguacagcuuuggguucgagaugaaggacaagaagugcgacgugcccugcaucggcaucgagauggugcacgauggcgggaaggagaccuggcacuccgccgccacggccaucuacugccugaugggcagcgggcagcuccugugggacaccgucaccggcguggacauggcccuguga

SEQ ID NO: 30430 - RNA, 1401 nt, Artificial Sequence; identical to SEQ ID NO: 30429
  derived and/or modified CDS sequence (AUadapt) from InfluenzaB__AHZ36800__NA

SEQ ID NO: 30431 - RNA, 1401 nt, Artificial Sequence
  derived and/or modified CDS sequence (AUadapt) from InfluenzaB__AHZ36811__NA
augcugcccaguaccauccagacccucacgcuguuccugaccuccggcggggugcuccugagccuguacgucuccgccagccucuccuaucugcuguacagcgacauccuccugaaguucucccagaccgagaucaccgccccgaucaugccccuggacuguacgaacgcgagcaacgugcaggccgugaaccgcuccgccgccaagggcgucacccuccugcugcccgagcccgaguggaccuacccgcggcucaguugccccggguccaccuuccagaaggcccugcugaucagcccccaccgcuuuggcgagaucaaggggaacuccgcgccccucaucauccgggagccguucaucgccugcggccccacggagugcaagcacuuugcccugacccacuacgccgcgcagcccggcggguacuacaacggcacccgcgaggaucggaacaagcugcgccaccucaucagcgugaagcuggggaagauccccaccguggagaacuccaucuuucacauggccgccuggagcggcuccgccugccacgacgggaaggaguggacguauaucggcgucgacggcccggacagcaacgcccugcucaagaucaaguacggggaggcguauaccgacaccuaccacuccuacgccaagaauauccugcggacccaggagagcgccugcaacugcaucggcggggacuguuaccugaugaucacggacggccccgccagcggcguguccgagugccgcuuccucaagauccgggaggggcgcaucauccgggagaucuuucccaccggccgcgugaagcacaccgaggagugcacgugcggguucgccaguaacaagaccaucgagugcgcgugccgggacaaccgcuauaccgccaagcggcccuucgucaagcugaacguggagaccgacaccgccgagauccgccugaugugcacggagaccuaccucgauaccccgcggcccaacgacggcuccaucaccgggcccugcgagagcgauggcgacaagggcuccgggggcaucaagggcggguucgugcaccagcgcauggccagcaagaucgggcggugguacucccgcacgaugaguaagaccaagcggaugggcaugggccuguacgucaaguacgacggggaccccuggaccgacuccgaggcccuggcgcucaguggcgugaugguguccauggaggagccggggugguacagcuucggcuucgagaucaaggauaagaagugcgacguccccugcaucgggaucgagauggugcacgacggcggcaagaccacguggcauuccgccgccaccgccaucuacugccugauggggagcggccagcugcucugggacaccgugaccggggucgacauggcccuguga

SEQ ID NO: 30432 - RNA, 1404 nt, Artificial Sequence; identical to SEQ ID NO: 30426
  derived and/or modified CDS sequence (AUadapt) from InfluenzaB__AHZ36822__NA

SEQ ID NO: 30433 - RNA, 1401 nt, Artificial Sequence
  derived and/or modified CDS sequence (AUadapt) from InfluenzaB__AHZ36833__NA
augcugcccaguaccauccagacccucacgcuguuccugaccuccggcggggugcuccugagccuguacgucuccgccagccucuccuaucugcuguacagcgacauccuccugaaguucuccccgaccgagaucaccgcccccacgcgcccccuggacugugcgaacgccagcaacgugcaggccgugaaccgguccgccaccaagggcgucacccuccugcugcccgagccggaguggaccuacccccgccucaguugccccggguccacguuccagaaggcccugcugaucucgccccaccgguucggcgagaccaaggggaauuccgcgccgcucaucauccgcgagcccuucaucgccugcggccccaacgagugcaagcacuuugcccugacccacuacgccgcgcagcccggcggguacuacaacggcacccgcggggaucggaacaagcugcggcaccucaucagcgugaagcugggcaagaucccgacgguggagaacuccaucuuccauauggccgccuggagcggguccgccugccacgacggcaaggaguggaccuacaucggcgucgaugggcccgacaacaacgcccugcucaaggugaaguacggcgaggcguacaccgauaccuaccacagcuacgccaacaagauccugcgcacgcaggaguccgccuguaacugcaucgggggcaacugcuaucugaugaucaccgacggcagcgccagcgggguguccgagugccgguuccucaagguccgcgagggccggaucaucaaggagaucuuucccaccgggcgcgugaagcacaccgaggagugcacgugcggcuucgccucgaauaagaccaucgagugcgcgugccgggacaaccgcuacaccgccaagcggcccuuugugaagcugaacgucgagaccgacacggccgagauccgccugaugugcaccgacaccuaccucgauaccccgcggcccaacgacggguccaucacgggccccugcgagagcgacggcgauaagggguccggcgggaucaagggcggguucgugcaccagcgcaugaaguccaagaucggccggugguacagccgcaccaugagcaagaccgagcggaugggcauggggcuguaugugaaguacgacggcgaccccugggccgacuccgacgcccuggcguuuagcggggucaugguguccaugaaggagccgggcugguacagcuucggguucgagaucaaggauaagaagugcgacgugcccugcaucggcaucgagaugguccacgacggcgggaaggagaccuggcauuccgccgccacggccaucuacugccucaugggcagcgggcagcugcugugggacaccgugaccggcguggacauggcccucuga

SEQ ID NO: 30434 - RNA, 1401 nt, Artificial Sequence
  derived and/or modified CDS sequence (AUadapt) from InfluenzaB__AHZ36844__NA
augcugcccaguaccauccagacccucacgcuguuccugaccuccggcggggugcuccugagccuguacgucuccgccagccucuccuaccugcuguauucggacauccuccugaaguucuccccgaccgagaucaccgcccccacgcgcccccuggacugcgcgaacgccaguaacgugcaggccgugaaccgguccgccaccaaggaggucacccuccugcugcccgagccggaguggaccuacccccgccucagcugccccggcuccacguuucagaaggcccugcugaucagcccccaccgguucggggagaccaagggcaacuccgcgccgcucaucauccgcgagcccuucaucgccugcgggcccaaugagugcaagcacuucgcccugacccacuacgccgcgcagcccggcggcuauuacaacgggacccggggcgaccgcaacaagcugcggcaccucaucucggugaagcuggggaagaucccgacgguggagaauuccaucuuccacauggccgccuggagcggcuccgccugccacgaugggaaggaguggaccuacaucggcgucgacggccccgacaacaacgcccugcucaaggugaaguacggggaggcguauaccgacaccuaccacagcuacgccaauaagauccugcgcacgcaggaguccgccugcaacugcaucggcgggaacugcuaccugaugaucaccgauggcagcgccucgggcguguccgagugccgguuccucaagauccgcgaggggcggaucaucaaggagaucuuccccaccggccgcgucaagcauaccgaggagugcacgugcggguucgccagcaacaagaccaucgagugcgcgugucgggacaaccgcuacaccgccaagcggcccuucgugaagcugaacguggagaccgauacggccgagauccgccugaugugcaccgacaccuaccucgacaccccgcggcccaacgacggcuccaucacggggcccugugagagcgacggcgacaagggcuccgggggcaucaagggcggguucguccaccagcgcaugaaguccaagaucgggcggugguauagccgcaccaugucgaagaccgagcggaugggcaugggccuguacgugaaguacgacggggaccccugggccgauuccgacgcccuggcguucagcggcgugauggucuccaugaaggagccggggugguacagcuuuggcuucgagaucaaggacaagaagugcgacgugcccugcaucgggaucgagauggugcacgauggcggcaaggagaccuggcacuccgccgccacggccaucuacugccucauggggagcggccagcugcugugggacaccgucaccgggguggacauggcccucuga

SEQ ID NO: 30435 - RNA, 1401 nt, Artificial Sequence
  derived and/or modified CDS sequence (AUadapt) from InfluenzaB__AHZ36855__NA
augcugcccaguaccauccagacccucacgcuguuccugaccuccggcggggugcuccugagccuguacgucuccgccagccucuccuaccugcuguacagugacauccuccugaaguucuccccgaccgagaucaccgugcagacgaugccccuggacugcgccaacgcgagcaaugugcaggccgucaaccgcuccgccaccaagggcgugacccuccugccgcccgagcccgaguggaccuacccccggcugagcugccccggguccacguuccagaaggcccuccugaucucgccccaucgcuucggcgagaccaaggggaacuccgccccgcugaucauccgggagcccuucaucgcgugcggccccaacgagugcaagcacuuugcccucacccacuacgccgcccagcccggcggguacuacaacggcacccgcggggaccggaauaagcugcgccaccugaucagcgugaagcucggcaagaucccgacggucgagaacuccaucuuccacauggcggccuggagcggguccgccugucacgacggcaaggaguggaccuacaucggcguggacgggcccgacaacaacgcccugcugaaggugaaguauggcgaggccuacaccgacaccuaccacucguacgcgaauaagauccuccggacgcaggaguccgccugcaacugcaucgggggcaacugcuaccugaugaucaccgauggcagcgccagcggggucuccgagugccgcuuccugaagauccgggagggccgcaucaucaaggagaucuuccccaccgggcgggugaagcacaccgaggaguguacgugcggcuucgccucgaacaagaccaucgagugcgccugccgcgacaaucgguacaccgcgaagcgccccuucgugaagcucaacgucgagaccgacacggccgagauccggcugaugugcaccgacaccuaucuggacaccccgcgccccaacgacggguccaucacgggccccugcgagagcgacggcgauaagggguccggcgggaucaagggcggguucgugcaccagcggaugaaguccaagaucggccgcugguacagccggaccaugucgaagaccgagcgcaugggcauggggcucuacgugaaguacgauggcgaccccugggccgacuccgacgcccuggccuucagcggggucaugguguccaugaaggagccgggcugguacaguuucggguucgagaugaaggacaagaagugcgacgugcccugcaucggcaucgagaugguccaugacggcgggaaggagaccuggcacuccgcggccacggccaucuacugccugaugggcagcgggcagcuccugugggacaccgugaccggcguggacauggcccuguga

SEQ ID NO: 30436 - RNA, 1404 nt, Artificial Sequence; identical to SEQ ID NO: 30426
  derived and/or modified CDS sequence (AUadapt) from InfluenzaB__AHZ36866__NA

SEQ ID NO: 30437 - RNA, 1401 nt, Artificial Sequence
  derived and/or modified CDS sequence (AUadapt) from InfluenzaB__AHZ36877__NA
augcugcccaguaccauccagacccucacgcuguuccugaccuccggcggggugcuccugagccuguacgucuccgccagccucuccuaccugcuguauagcgacauccuccugaaguucuccccgcccgagaucaccgcccccaccaugccccuggacugcgcgaacgccaguaacgugcaggccgugaaccgcuccgccacgaagggcgucacccuccugcugccggagcccgaguggaccuacccccggcucagcugccccggguccaccuuucagaaggcccugcugaucagcccgcaccgcuucggcgagacgaaggggaacuccgcgccccucaucauccgggagcccuucaucgccugcggccccaaugagugcaagcacuucgcccugacccacuacgccgcgcagccgggcggguauuacaacggcacccgcggggaccggaacaagcugcgccaccucaucagcgugaagcugggcaagauccccaccguggagaauuccaucuuccacauggccgccuggagcggguccgccugccacgauggcaaggaguggacguacaucggcgucgacgggcccgacaacaacgcccugcucaaggugaaguacggcgaggcguauaccgacaccuaccacucguacgccaauaagauccugcggacccaggaguccgccugcaacugcaucgggggcaacugcuaccugaugaucacggauggcagcgccagcgggguguccgagugccgcuuccucaagauccgggagggccgcaucaucaaggagaucuuccccaccgggcgggucaagcauaccgaggagugcacgugcggcuucgccagcaacaagaccaucgagugcgcgugucgcgacaaccgguacaccgccaagcgcccguucgugaagcugaacguggagaccgauaccgccgagauccggcugaugugcacggacaccuaccucgacacgccccgccccaacgacggguccaucaccggccccugugagagcgacggcgacaagggguccggcgggaucaagggcggguucguccaccagcggaugaaguccaagaucggccgcugguauucgcggaccaugagcaagaccgagcgcaugggcauggggcuguacgugaaguacgacggcgacccgugggccgauuccgacgcccuggcguucagcggggugauggucuccaugaaggagcccggcugguacagcuuuggguucgagaucaaggacaagaagugcgacgugcccugcaucggcaucgagauggugcacgauggcgggaaggagaccuggcacuccgccgccaccgccaucuacugccucaugggcagcgggcagcugcugugggacacggucaccggcguggacauggcccucuga

SEQ ID NO: 30438 - RNA, 1404 nt, Artificial Sequence; identical to SEQ ID NO: 30426
  derived and/or modified CDS sequence (AUadapt) from InfluenzaB__AHZ36888__NA

SEQ ID NO: 30439 - RNA, 1404 nt, Artificial Sequence; identical to SEQ ID NO: 30426
  derived and/or modified CDS sequence (AUadapt) from InfluenzaB__AHZ36899__NA

SEQ ID NO: 30440 - RNA, 1404 nt, Artificial Sequence; identical to SEQ ID NO: 30426
  derived and/or modified CDS sequence (AUadapt) from InfluenzaB__AHZ36910__NA

SEQ ID NO: 30441 - RNA, 1401 nt, Artificial Sequence; identical to SEQ ID NO: 30428
  derived and/or modified CDS sequence (AUadapt) from InfluenzaB__AHZ36921__NA

SEQ ID NO: 30442 - RNA, 1401 nt, Artificial Sequence
  derived and/or modified CDS sequence (AUadapt) from InfluenzaB__AHZ36932__NA
augcugcccaguaccauccagacccucacgcuguuccugaccuccggcggggugcuccugagccuguacgucuccgccagccucuccuaccugcuguauucggacauccuccugaaguucuccccgaccgagaucaccgcccagacgaugccccuggacugcgcgaacgccaguaacgugcaggccgugaaccgcuccgccaccaagggcgucacccuccugccgcccgagcccgaguggaccuacccccggcugagcugccccggguccacguuccagaaggcccuccugaucaguccccaccgcuucggcgagaccaaggggaacuccgcgccgcugaucauccgggagcccuucaucgccugcggccccaacgaguguaagcacuucgcccucacccacuacgccgcgcagcccggcggguacuacaauggcacccgcggggaccggaacaagcugcgccaccugaucagcgugaagcucggcaagaucccgacgguggagaacuccaucuuccauauggccgccuggagcggguccgccugccacgacggcaaggaguggaccuacaucggcgucgacgggcccgauaacaacgcccugcugaaggugaaguacggcgaggcguacaccgacaccuaccauucguacgccaacaagauccuccggacgcaggaguccgccugcaacugcaucgggggcaauugcuaccugaugaucaccgacggcagcgccagcgggguguccgagugucgcuuccugaagauccgggagggccgcaucaucaaggagaucuuccccaccgggcgggucaagcacaccgaggagugcacgugcggcuucgccaguaacaagaccauggagugcgcgugccgcgacaaccgguacaccgccaagcgccccuuugugaagcucaacguggagaccgacacggccgagauccggcugaugugcaccgacaccuaccuggacaccccgcgccccaaugacggguccaucacgggccccugcgagagcgacggcgacaagggguccggcgggaucaagggcggguucguccaucagcggaugaaguccaagaucggccgcugguacagccggaccaugucgaagaccgagcgcaugggcauggggcucuacgugaaguacgacggcgaucccugggccgacuccgacgcccuggcguucagcggggugauggucuccaugaaggagccgggcugguacagcuuuggguucgagaugaaggacaagaagugcgacgugcccugcaucggcaucgagauggugcacgauggcgggaaggagaccuggcacuccgccgccacggccaucuacugccugaugggcagcgggcagcuccugugggacaccgucaccggcguggacauggcccuguga

SEQ ID NO: 30443 - RNA, 1401 nt, Artificial Sequence
  derived and/or modified CDS sequence (AUadapt) from InfluenzaB__AHZ36943__NA
augcugcccaguaccauccagacccucacgcuguuccugaccuccggcggggugcuccugagccuguacgucuccgccagccucuccuaucugcuguacagcgacauccuccugaaguucuccccgaccgagaucaccgcccccacgaugccccuggacugugcgaacgccagcaacgugcaggccgugaaccgcuccgccaccaagggcgucacccuccugcccccggagcccgaguggaccuacccccggcugaguugccccggguccacguuccagaaggcccuccugaucucgccgcaccgcuucggcgagaccaaggggaauuccgcgccccugaucauccgggagcccuucaucgccugcggccccaacgagugcaagcacuuugcccucacccacuacgccgcgcagccgggcggguacuacaacggcacccgcggggaucggaacaagcugcgccaccugaucagcgugaagcucggcaagauccccacgguggagaacuccaucuuccauauggccgccuggagcggguccgccugccacgacggcaaggaguggaccuacaucggcgucgaugggcccgacaacaacgcccugcugaaggugaaguacggcgaggcguacaccgauaccuaccacagcuacgccaacaagauccuccggacgcaggaguccgccuguaacugcaucgggggcaacugcuaucugaugaucaccgacggcagcgccagcgggguguccgagugccgcuuccugaagauccgggagggccgcaucaucaaggagaucuuucccaccgggcgggucaagcacaccgaggagugcacgugcggcuucgccucgaauaagaccaucgagugcgcgugccgcgacaaccgguacaccgccaagcgcccguuugugaagcucaacguggagaccgacacggccgagauccggcugaugugcaccgacaccuaccuggauacgccccgccccaacgacggguccaucaccggccccugcgagagcgacggcgauaagggguccggcgggaucaagggcggguucguccaccagcggaugaaguccaagaucggccgcugguacagccggaccaugagcaagaccgagcgcaugggcauggggcucuaugugaaguacgacggcgacccgugggccgacuccgacgcccuggcguuuagcggggugauggucuccaugaaggagcccggcugguacagcuucggguucgagaugaaggaucggaagugcgacgugcccugcaucggcaucgagauggugcacgacggcgggaaggagaccuggcauuccgccgccacggccaucuacugccugaugggcagcgggcagcuccugugggacaccgucaccggcguggacauggcccuguga

SEQ ID NO: 30444 - RNA, 1404 nt, Artificial Sequence; identical to SEQ ID NO: 30426
  derived and/or modified CDS sequence (AUadapt) from InfluenzaB__AHZ36954__NA

SEQ ID NO: 30445 - RNA, 1401 nt, Artificial Sequence
  derived and/or modified CDS sequence (AUadapt) from InfluenzaB__AHZ36965__NA
augcugcccaguaccauccagacccucacgcuguuccugaccuccggcggggugcuccugagccuguacgucuccgccagccucuccuaccugcuguauucggacauccuccugaaguucuccccgcccgagaucaacgcccccaccaugccccuggacugcgcgaaugccagcaacgugcaggccgugaaccgcuccgccaccaagggcgucacgcuccugcugccggagcccgaguggaccuacccccggcucagcugccccggguccaccuuucagaaggcccugcugaucagcccgcaccgcuucggcgagaccaaggggaacuccgcgccccucaucauccgggagcccuucaucgccugcggccccaaugagugcaagcacuucgcccugacgcacuacgccgcgcagccgggcggguacuauaacggcacccgcggggaccggaacaagcugcgccaccucaucucggugaagcugggcaagauccccaccguggagaacuccaucuuucacauggccgccuggagcggguccgccugccacgacggcaaggaguggaccuacaucggcgucgaugggcccgacaacaacgcccugcucaaggugaaguacggcgaggcguacacggacaccuaucacagcuacgccaacaagauccugcggacccaggaguccgccugcaacuguaucgggggcaacugcuaccugaugaucaccgacggcagcgccucggggguguccgagugucgcuuccucaagauccgggagggccgcaucaucaaggagaucuuccccacggggcgggucaagcacaccgaggagugcacgugcggcuucgccaguaacaagaccaucgagugcgcgugccgcgacaaccgguacaccgccaagcgcccguuugugaagcugaacguggagaccgacaccgccgagauccggcugaugugcaccgacacguaccucgacacgccccgccccaaugacggguccaucaccggccccugcgagagcgacggcgacaagggguccggcgggaucaagggcggguucguccaucagcggaugaaguccaagaucggccgcugguacagccggaccaugucgaagaccgagcgcaugggcauggggcuguacgugaaguacgacggcgauccgugggccgacuccgacgcccuggcguucagcggggugauggucuccaugaaggagcccggcugguacagcuuuggguucgagaucaaggacaagaagugcgacgugcccugcaucggcaucgagauggugcacgauggcgggaaggagaccuggcacuccgccgccaccgccaucuacugccucaugggcagcgggcagcugcugugggacaccgucacgggcguggacauggcccucuga

SEQ ID NO: 30446 - RNA, 1404 nt, Artificial Sequence; identical to SEQ ID NO: 30426
  derived and/or modified CDS sequence (AUadapt) from InfluenzaB__AHZ36976__NA

SEQ ID NO: 30447 - RNA, 1404 nt, Artificial Sequence; identical to SEQ ID NO: 30426
  derived and/or modified CDS sequence (AUadapt) from InfluenzaB__AHZ36987__NA

SEQ ID NO: 30448 - RNA, 1401 nt, Artificial Sequence; identical to SEQ ID NO: 30429
  derived and/or modified CDS sequence (AUadapt) from InfluenzaB__AHZ36998__NA

SEQ ID NO: 30449 - RNA, 1401 nt, Artificial Sequence
  derived and/or modified CDS sequence (AUadapt) from InfluenzaB__AHZ37009__NA
augcugcccaguaccauccagacccucacgcuguuccugacccucggcggggugcugcugucccucuacgucagcgccucccugagcuaccugcucuauuccgacauccugcugaaguucagcccgaccgagaucaccgcccccacgaugccccucggcugcgcgaacgccuccaaugugcaggccgugaaccgcagcgccaccaagggggucacccugcugcuccccgagccggaguggaccuacccccggcuguccugccccggcagcacguuucagaaggcccugcucaucagcccccaccgcuucggggagaccaagggcaacuccgcgccgcugaucauccgggagcccuucaucgccuguggccccaacgagugcaagcacuucgcccugacccacuaugccgcgcagcccgggggcuacuacaacgggacccgcggcgaccggaacaagcuccgccaucugaucuccgugaagcuggggaagaucccgacgguggagaacagcaucuuccacauggccgccugguccggcagcgccugucacgacggcaaggaguggaccuacaucggggucgacggccccgacaauaacgcccuccugaaggugaaguacggggaggcguacaccgacaccuaccauuccuacgccaacaagauccugcggacgcaggagucggccugcaacugcaucggcggcaauugcuaccucaugaucaccgacggguccgccagcggcgugagcgagugucgcuuccugaagauccgggaggggcgcaucaucaaggagaucuuccccaccggccgggucaagcacaccgaggagugcacgugcggguuugccuccaacaagaccaucgagugcgcgugccgcgacaaccgguauaccgccaagcgccccuucgugaagcugaacguggaggccgacaccgccgagauccggcucaugugcacggacaccuaucuggacaccccgcgccccaacgacggcagcaucaccggccccugcgaguccgauggggacaagggcagcgggggcaucaagggcggguucguccaccagcggaugaaguccaagaucggccgcugguacagucggacgauguccaagaccgagcgcauggggaugggccuguacgugaaguacgacggggaccccugggccgacagugacgcgcucgccuucuccggcgugauggucagcaugaaggagccggggugguacuccuucggcuuugagaucaaggacaagaagugcgacgugcccugcaucggcaucgagauggugcacgaugggggcaaggagaccuggcacagcgccgccaccgccaucuacugccugaugggguccggccagcugcucugggacacggucaccggcguggacauggcgcuguga

SEQ ID NO: 30450 - RNA, 1401 nt, Artificial Sequence; identical to SEQ ID NO: 30427
  derived and/or modified CDS sequence (AUadapt) from InfluenzaB__AHZ37020__NA

SEQ ID NO: 30451 - RNA, 1401 nt, Artificial Sequence; identical to SEQ ID NO: 30429
  derived and/or modified CDS sequence (AUadapt) from InfluenzaB__AHZ37031__NA

SEQ ID NO: 30452 - RNA, 1401 nt, Artificial Sequence; identical to SEQ ID NO: 30427
  derived and/or modified CDS sequence (AUadapt) from InfluenzaB__AHZ37042__NA

SEQ ID NO: 30453 - RNA, 1401 nt, Artificial Sequence; identical to SEQ ID NO: 30429
  derived and/or modified CDS sequence (AUadapt) from InfluenzaB__AHZ37064__NA

SEQ ID NO: 30454 - RNA, 1401 nt, Artificial Sequence; identical to SEQ ID NO: 30427
  derived and/or modified CDS sequence (AUadapt) from InfluenzaB__AHZ37075__NA

SEQ ID NO: 30455 - RNA, 1401 nt, Artificial Sequence; identical to SEQ ID NO: 30427
  derived and/or modified CDS sequence (AUadapt) from InfluenzaB__AHZ37086__NA

SEQ ID NO: 30456 - RNA, 1401 nt, Artificial Sequence
  derived and/or modified CDS sequence (AUadapt) from InfluenzaB__AHZ37097__NA
augcugcccaguaccauccagacccucacgcuguuccugaccuccggcggggugcuccugagccuguacgucuccgccagccucuccuaccugcuguauucggacauccuccugaaguucuccccgaccgagaucaccgcccccacgaugccccuggacugcgcgaacgccaguaacgugcaggccgugaaccgcuccgccaccaagggcgucacccuccugcccccggagcccgaguggaccuacccccggcugagcugccccggguccacguuucagaaggcccuccugaucagcccgcaccgcuucggcgagaccaaggggaacuccgcgccccugaucauccgggagcccuucaucgccugcggccccaaugagugcaagcacuucgcccucacccacuacgccgcgcagccgggcggguauuacaacggcacccgcggggaccggaacaagcugcgccaccugaucucggugaagcucggcaagauccccacgguggagaauuccaucuuccacauggccgccuggagcggguccgccugccacgauggcaaggaguggaccuacaucggcgucgacgggcccgacaacaacgcccugcugaaggugaaguacggcgaggcguauaccgacaccuaccacagcuacgccaauaagauccuccggacgcaggaguccgccugcaacugcaucgggggcaacugcuaccugaugaucaccgauggcagcgccucggggguguccgagugccgcuuccugaagauccgggagggccgcaucaucaaggagaucuuccccaccgggcgggucaagcauaccgaggagugcacgugcggcuucgccagcaacaagaccaucgagugcgcgugucgcgacaaccgguacaccgccaagcgcccguucgugaagcucaacguggagaccgauacggccgagauccggcugaugugcaccgacaccuaccuggacacgccccgccccaacgacggguccaucaccggccccugugagagcgacggcgacaagggguccggcgggaucaagggcggguucguccaccagcggaugaaguccaagaucggccgcugguauagccggaccaugucgaagaccgagcgcaugggcauggggcucuacgugaaguacgacggcgacccgugggccgauuccgacgcccuggcguucagcggggugauggucuccaugaaggagcccggcugguacagcuuuggguucgagaugaaggacaagaagugcgacgugcccugcaucggcaucgagauggugcacgauggcgggaaggagaccuggcacuccgccgccacggccaucuacugccugaugggcagcgggcagcuccugugggacaccgucaccggcguggacauggcccuguga

SEQ ID NO: 30457 - RNA, 1401 nt, Artificial Sequence; identical to SEQ ID NO: 30427
  derived and/or modified CDS sequence (AUadapt) from InfluenzaB__AHZ37108__NA

SEQ ID NO: 30458 - RNA, 1401 nt, Artificial Sequence
  derived and/or modified CDS sequence (AUadapt) from InfluenzaB__AHZ41774__NA
augcugcccaguaccauccagaugcucacccuguuccugacguccggcggggugcuccugagccuguacgucuccgccagccucuccuaccugcuguacucggauauccuccugaaguucuccccgaccgagaucaccgcccccaccaugccccuggacugcgcgaacgccagcaacgugcacgccgugaaucgguccgccacgaagggcgucaccuuccuccugcccgagccggaguggaccuacccccggcugagcugccccggguccaccuuccagaaggcccuccugaucucgccccaccgcuuuggcgagacgaaggggaacuccgcgccgcugaucauccgggagcccuucaucgccugcggcagcaacgagugccgccacuuugcccucacccacuacgccgcgcagcccggcggguacuacaacggcacccgcggggaccggaacaagcugcggcaucugaucuccgugaagcucggcaagauccccaccguggagaacagcaucuuccacauggccgccugguccgggucggccugccacgauggcaaggaguggacguacaucggcgucgacgggccggacaacaacgcccugcugaagaucaaguacggcgaggcguacaccgauaccuaccacuccuacgccaacaacauccuccgcacccaggagagcgccugcaauugcaucgggggcaacugcuaccugaugaucacggacggcagcgccuccggggugucggagugucgguuccugaagauccgcgagggccggaucaucaaggagaucuuccccaccgggcgcgugaagcacaccgaggagugcacgugcggcuucgccuccaacaagaccaucgagugugcgugccgggacaacagcuacaccgccaagcgccccuucgucaagcucaacguggagaccgauaccgccgagauccggcugaugugcacggacaccuaccuggacacgccccgcccggacgacggguccaucaccggccccugcgagaguaacggcgacaagggguccggcgggaucaagggcggguucgugcaccagcggauggccucgaagaucggccgcugguacucccggaccaugagcaagaccgagcgcaagggcauggggcucuaugucaaguacgacggcgaccccuggaccgacaacgacgcccuggcguuccgcggggugaugguguccaugaaggagcccggcugguauagcuucggguucgagaucaaggacaagaagugcgacgucccgugcaucggcaucgagauggugcaugacggcgggaaggagaccuggcacuccgccgccacggccaucuacugccugaugggcagcgggcagcuccugugggacaccgugaccggcgucgacauggcccuguga

SEQ ID NO: 30459 - RNA, 1401 nt, Artificial Sequence; identical to SEQ ID NO: 29069
  derived and/or modified CDS sequence (AUadapt) from InfluenzaB__AHZ41785__NA

SEQ ID NO: 30460 - RNA, 1401 nt, Artificial Sequence; identical to SEQ ID NO: 29069
  derived and/or modified CDS sequence (AUadapt) from InfluenzaB__AHZ41796__NA

SEQ ID NO: 30461 - RNA, 1401 nt, Artificial Sequence
  derived and/or modified CDS sequence (AUadapt) from InfluenzaB__AHZ41807__NA
augcugcccaguaccauccagaugcucacccuguuccugacguccggcggggugcuccugagccuguacgucuccgccucgcucuccuaccugcuguacagcgauauccuccugaaguucuccccgaccgagaucaccgcccccaccaugccccuggacugcgcgaacgccagcaacgugcacgccgugaaucgcuccgccacgaagggcgucaccuuccuccugcccgagccggaguggaccuacccccggcugucgugccccggguccaccuuccagaaggcccuccugaucagcccccaccgcuucggcgagacgaaggggaauuccgcgccgcugaucauccgggagcccuucaucgccugcggccccaacgagugcaagcacuucgcccucacccacuaugccgcgcagcccggcggguacuacaacggcacccgcggggaccggaacaagcugcgccaccugaucagcgugaagcucggcaagaucccgaccguggagaacuccaucuuucacauggccgccuggucgggguccgccugccacgacggcaaggaguggacguacaucggcgucgacgggcccgauaacaacgcccugcugaagaucaaguacggcgaggcguacaccgacaccuaccacagcuaugccaacaacauccuccggacccaggaguccgccugcaacugcaucgaggggaacugcuaucugaugaucacggacggcucggccagcggcguguccgagugccgcuuccugaagauccgggaggggcgcaucaucaaggagaucuuccccaccggccgggugaagcacaccgaggagugcacguguggguucgccagcaacaagaccaucgagugcgcgugccgcgacaacuccuauaccgccaagcggcccuucgucaagcucaacguggagaccgacaccgccgagauccgccugaugugcacggacaccuaccuggacaccccgcggcccgacgauggcucgaucaccgggcccugcgaguccaacggcgacaagggcagcgggggcaucaagggcggguucgugcaccagcgcauggccuccaagaucgggcggugguauagccgcacgauguccaagaccgagcggaagggcaugggccucuacgucaaguacgacggggaccccuggaccgacucggacgcccuggcguuucgcggcgugaugguguccaugaaggagccggggugguacagcuucggcuucgagaucaaggacaagaagugcgacguccccuguaucgggaucgagauggugcacgacggcggcaaggagaccuggcacuccgccgccacggccaucuacugccugauggggagcggccagcuccugugggacaccgugaccggggucgacauggcccuguga

SEQ ID NO: 30462 - RNA, 1401 nt, Artificial Sequence
  derived and/or modified CDS sequence (AUadapt) from InfluenzaB__AHZ41818__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccucgaaugugcaggccgugaaccgcuccgccaccaagggcgucacccuccugcugcccgagccggaguggaccuacccccggcucagcugccccggguccacguuccagaaggcccugcugaucagcccccaucgcuucggcgagaccaaggggaacuccgcgccgcucaucauccgggagcccuucaucgccugcggccccaacgagugcaagcacuuugcccugacccacuacgccgcgcagcccggcggguacuacaacggcacccgcggggaccggaauaagcugcgccaccucaucagcgugaagcugggcaagaucccgacgguggagaacuccaucuuccacauggccgccuggagcggguccgccugucacgacggcaaggaguggaccuacaucggcgucgacgggcccgacaacaacgcccugcucaaggugaaguauggcgaggcguacaccgacaccuaccacucguacgccaauaagauccugcggacgcaggaguccgccugcaacugcaucgggggcaacugcuaccugauggugaccgauggcagcgccagcggggucuccgagugccgcuuccucaagauccgggagggccgcaucaucaaggagaucuuccccaccgggcgggugaagcacaccgaggaguguacgugcggcuucgccagcaacaagaccaucgagugcgcgugccgcgacaauuccuacaccgccaagcggcccuucgugaagcugaacgucgagaccgacacggccgagauccgccugaugugcaccgacaccuaucucgacaccccgcggcccgacgacgggagcaucacgggccccugcgaguccaacggcgauaaggggucgggcgggaucaagggcggguucgugcaccagcgcauggaguccaagaucggccggugguacagccgcaccauguccaagaccgagcggaugggcauggggcuguacgugaaguacgauggcgaccccugggccgacagcgacgcccuggucuucuccggggugauggugagcaugaaggagccgggcugguauuccuucggguucgagaucaaggacaagaagugcgacguccccugcaucggcaucgagauggugcaugacggcgggaaggagaccuggcacagcgcggccacggccaucuacugccucaugggcuccgggcagcugcugugggacaccgugaccggcgucaacauggcccucuga

SEQ ID NO: 30463 - RNA, 1401 nt, Artificial Sequence; identical to SEQ ID NO: 29069
  derived and/or modified CDS sequence (AUadapt) from InfluenzaB__AHZ41829__NA

SEQ ID NO: 30464 - RNA, 1401 nt, Artificial Sequence
  derived and/or modified CDS sequence (AUadapt) from InfluenzaB__AHZ41840__NA
augcugcccaguaccauccagaugcucacccuguuccugacguccggcggggugcuccugagccuguacgucuccgccagccucuccuaccugcuguacagugacauccuccugaaguucuccccgaccgagaucaccgcccccaccaugccccuggacugcgcgaacgccucgaaugugcacgccgugaaccgguccgccacgaagggcgucaccuuccuccugcccgagccggaguggaccuacccccggcugagcugccccggguccaccuuucagaaggcccuccugaucagcccccaccgcuucggcgagacgaaggggaacuccgcgccgcugaucauccgggagcccuucaucgccugcggccccaaugagugccgccacuucgcccucacccacuacgccgcgcagcccggcggguacuauaacggcacccgcggggaccggaacaagcugcggcaccugaucagcgugaagcucggcaagaucccgaccguggagaacuccaucuuucacauggccgccuggagcggguccgccugccacgacggcaaggaguggacguacaucggcgucgaugggcccgacaacaacgcccugcugaagaucaaguacggcgaggcguacaccgacaccuaucacucguacgccaacaacauccuccgcacccaggaguccgccugcaauugcaucgggggcaacugcuaccugaugaucacggacggcagcgccagugggguguccgagugccgguuccugaagauccgcgagggccggaucaucaaggagaucuuccccaccgggcgcgugaagcacaccgaggagugcacgugcggcuuugccagcaacaagaccaucgagugcgcgugccgggacaacuccuauaccgccaagcgccccuucgucaagcucaacguggagaccgacaccgccgagauccggcugaugugcacggacaccuaccuggauaccccgcgccccgacgacgggagcaucaccggccccugcgaguccaacggcgacaaggggaguggcgggaucaagggcggguucgugcaccagcggauggccuccaagaucggccgcugguacagccggacgauguccaagaccgagcgcaagggcauggggcucuacgucaaguacgauggcgaccccuggaccgacagcgacgcccuggcguuccgcggggugaugguguccaugaaggagccgggcugguacaguuucggguucgagaucaaggacaagaagugcgacguccccugcaucggcaucgagauggugcaugacggcgggaaggagaccuggcacuccgccgccacggccaucuacugccugaugggcagcgggcagcuccugugggacaccgugaccggcgucgacauggcccuguga

SEQ ID NO: 30465 - RNA, 1401 nt, Artificial Sequence; identical to SEQ ID NO: 29069
  derived and/or modified CDS sequence (AUadapt) from InfluenzaB__AHZ41851__NA

SEQ ID NO: 30466 - RNA, 1401 nt, Artificial Sequence; identical to SEQ ID NO: 30315
  derived and/or modified CDS sequence (AUadapt) from InfluenzaB__AHZ41862__NA

SEQ ID NO: 30467 - RNA, 1401 nt, Artificial Sequence
  derived and/or modified CDS sequence (AUadapt) from InfluenzaB__AHZ41873__NA
augcugcccaguaccauccagacccucacgcuguuccugaccuccggcggggugcuccugagccuguacgucuccgccagccucuccuaccugcuguauucggacauccuccugaaguucuccccgaccgagaucaccgcccccacgaugccccuggacugcgcgaacgccaguaacgcccaggccgugaaccgcuccgccaccaagggcgugacccuccugcugcccgagccggaguggaccuacccccggcucagcugccccggguccacguuccagaaggcgcugcugaucaguccccaccgcuucggcgagaccaaggggaacuccgccccgcucaucauccgggagcccuucaucgccugcggccccaacgaguguaagcacuucgcccugacccacuacgcggcccagcccggcggguacuacaauggcacccgcggggaccggaacaagcugcgccaccucaucagcgucaagcugggcaagaucccgacgguggagaacuccaucuuccauauggccgccuggagcggguccgccugccacgacggcaaggaguggaccuacaucggcguggacgggcccgauaacaacgcgcugcucaaggucaaguacggcgaggccuacaccgacaccuaccauucguacgccaacaagauccugcggacgcaggaguccgccugcaacugcaucgggggcaauugcuaccugaugaucaccgacggcagcgccagcgggguguccgagugucgcuuccucaagauccgggagggccgcaucaucaaggagaucuuccccaccgggcgggugaagcacaccgaggagugcacgugcggcuucgcgaguaacaagaccaucgagugcgccugccgcgacaaccgguacaccgccaagcgccccuuugucaagcugaacguggagaccgacacggccgagauccggcugaugugcaccgacaccuaccucgacaccccgcgccccaaugacggguccaucacgggccccugcgagagcgacggcgacaagggguccggcgggaucaagggcggguucgugcaucagcggaugaaguccaagaucggccgcugguacagccggaccaugucgaagaccgagcgcaugggcauggggcuguacgucaaguacgacggcgaucccugggccgacuccgacgcgcugaccuucagcggggugaugguguccaugaaggagccgggcugguacagcuuuggguucgagaucaaggacaagaagugcgacguccccugcaucggcaucgagauggugcacgauggcgggaaggagacguggcacuccgccgccaccgccaucuacugccucaugggcagcgggcagcugcugugggacaccgugaccggcgucgacauggcccucuga

SEQ ID NO: 30468 - RNA, 1401 nt, Artificial Sequence; identical to SEQ ID NO: 28905
  derived and/or modified CDS sequence (AUadapt) from InfluenzaB__AIL94981__NA

SEQ ID NO: 30469 - RNA, 1401 nt, Artificial Sequence; identical to SEQ ID NO: 28905
  derived and/or modified CDS sequence (AUadapt) from InfluenzaB__AIL94992__NA

SEQ ID NO: 30470 - RNA, 1401 nt, Artificial Sequence; identical to SEQ ID NO: 28686
  derived and/or modified CDS sequence (AUadapt) from InfluenzaB__AIL95003__NA

SEQ ID NO: 30471 - RNA, 1401 nt, Artificial Sequence
  derived and/or modified CDS sequence (AUadapt) from InfluenzaB__AIL95014__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaaugccagcaacgugcaggccgugaaccgcuccgccgccaagggcgucacgcuccugcugcccgagcccgaguggaccuacccgcggcucagcugucccggguccaccuuccagaaggcgcugcugaucucgccccaccgcuucggcgagaccaaggggaacuccgcgccccucaucauccgggagccguucaucgccuguggccccacggagugcaagcacuucgcccugacccacuacgccgcccagcccggcggguauuacaacggcacccgcgaggaccggaacaagcugcgccaccucaucagugugaagcuggggaagauccccaccguggagaacuccaucuuccacauggccgccuggagcggcuccgccugccaugacgggaaggaguggacguacaucggcgucgacggcccggacagcaacgcgcugcucaagaucaaguauggggaggccuacaccgacaccuaccacuccuacgccaagaauauccugcggacccaggagagcgccugcaacugcaucggcggggacuguuaccugaugaucacggacggccccgccagcggcguguccgagugccgcuuccucaagauccgggaggggcgcaucaucaaggagaucuuucccaccggccgggugaagcacaccgaggagugcacgugcggguucgcgucgaacaagaccaucgagugugccugccgcgacaacuccuacaccgccaagcggcccuucgucaagcugaauguggagaccgacaccgccgagauccgccugaugugcacggagaccuaccucgacaccccgcggcccaacgauggcagcaucaccgggcccugcgaguccgacggcgacaagggcagcgggggcaucaagggcggguuugugcaccagcgcauggccuccaagaucgggcggugguacagccgcacgauguccaagaccaagcggaugggcaugggccuguacgucaaguacgacggggaucccuggaccgacagcgaggcgcuggcccucuccggcgugauggugagcauggaggagccggggugguacuccuucggcuuugagaucaaggacaagaagugcgacguccccugcaucgggaucgagauggugcacgauggcggcaagaccacguggcacagcgccgccaccgccaucuacugccugaugggguccggccagcugcucugggacaccgugaccggggucgacaugacgcuguga

SEQ ID NO: 30472 - RNA, 1401 nt, Artificial Sequence; identical to SEQ ID NO: 28686
  derived and/or modified CDS sequence (AUadapt) from InfluenzaB__AIL95025__NA

SEQ ID NO: 30473 - RNA, 1401 nt, Artificial Sequence
  derived and/or modified CDS sequence (AUadapt) from InfluenzaB__AIL95036__NA
augcugaguuccaccauccagacccucacgcuguuccugaccagcggcggggugcuccugucccuguacgucucggccucccucagcuaccugcuguacuccgauauccuccugaaguucagccccaaggagaucaccgccccgaccaugccccuggacugcgcgaacgccuccaacgugcaggccgugaaccauucggccacgaagggcgucacccuccugcugcccgagcccgaguggaccuacccgcgccucuccugccccgggagcaccuuccagaaggcccugcugaucagcccccaccgguucggcgagacgaaggggaauuccgcgccccucaucauccgcgagccguucaucgccugcggccccaacgagugcaagcacuucgcccugacccacuaugccgcgcagcccggcggguacuacaacggcacccgcggggaccggaacaagcugcggcaccucaucuccgugaagcugggcaagauccccaccguggagaacucgaucuuucacauggccgccugguccgggagcgccugccacgacggcaaggaguggacguacaucggcgucgacgggccggauaacaacgcccugcucaaggugaaguacggcgaggcguacaccgacaccuaccacuccuaugccaacaagauccugcgcacccaggagagcgccugcaacugcaucgggggcaacugcuaccugaugaucacggauggcucggccuccggggugagcgagugccgguuccucaagauccgcgagggccggaucaucaaggagaucuuccccaccgggcgcgucaagcacaccgaggagugcacguguggcuucgccuccaacaagaccaucgagugcgcgugccgggacaacagcuacaccgccaagcgccccuuugugaagcugaacguggagaccgacaccgccgagauccggcugaugugcacggacaccuaccucgacacgccccgcccggacgauggguccaucaccggccccugcgagucgaacggcgacaagggguccggcgggaucaagggcggguucguccaccagcggauggagagcaagaucggccgcugguauucccggaccaugagcaagaccgagcgcaugggcauggggcuguacgugaaguacgacggcgaccccugggccgacuccgacgcccuggcguucaguggggugauggucuccaugaaggagcccggcugguacagcuucggguucgagaucaaggacaagaagugcgacgugccguguaucggcaucgagauggugcacgacggcgggaaggagaccuggcacuccgccgccaccgccaucuacugccucaugggcagcgggcagcugcugugggacacggucaccggcguggacauggcccucuga

SEQ ID NO: 30474 - RNA, 1401 nt, Artificial Sequence; identical to SEQ ID NO: 28686
  derived and/or modified CDS sequence (AUadapt) from InfluenzaB__AIL95047__NA

SEQ ID NO: 30475 - RNA, 1401 nt, Artificial Sequence; identical to SEQ ID NO: 29039
  derived and/or modified CDS sequence (AUadapt) from InfluenzaB__AIL95058__NA

SEQ ID NO: 30476 - RNA, 1401 nt, Artificial Sequence; identical to SEQ ID NO: 28988
  derived and/or modified CDS sequence (AUadapt) from InfluenzaB__AIL95069__NA

SEQ ID NO: 30477 - RNA, 1401 nt, Artificial Sequence
  derived and/or modified CDS sequence (AUadapt) from InfluenzaB__AIL95080__NA
augcugcccaguaccauccagacccucacgcuguuccugaccuccggcggggugcuccugagccuguacgucuccgccucgcucuccuaccugcuguacagcgauauccuccugaaguucuccccgaaggagaucaccgcccccaccaugccccuggacugcgcgaacgccagcaacgugcaggccgugaaccauuccgccacgaagggcgucacccuccugcugcccgagccggaguggaccuacccccgccucucgugccccggguccaccuuccagaaggcccugcugaucagcccccaccgguucggcgagacgaaggggaacuccgcgccgcucaucauccgcgagcccuuuaucgccugcggccccaacgagugcaagcacuucgcccugacccacuacgccgcgcagcccggcggguauuacaacggcacccgcggggaccggaacaagcugcggcaccucaucagcgugaagcugggcaagaucccgaccguggagaacuccaucuuucacauggccgccuggucgggguccgccugcaacgacggcaaggaguggacguacaucggcgucgacgggcccgacaauaacgcccugcucaaggugaaguacggcgaggcguacaccgacaccuaccacagcuaugccaacaagauccugcgcacccaggaguccgccugcaacugcaucgggggcaacugcuaccugaugaucacggauggcucggccagcgggguguccgagugccgguuccucaagauccgcgagggccggaucaucaaggagaucuuccccaccgggcgcgucaagcacaccgaggagugcacgugcggcuuugccagcaacaagaccaucgagugcgcgugccgggacaacuccuacaccgccaagcgccccuuugugaagcugaacguggagaccgacaccgccgagauccggcugaugugcacggacaccuaccucgacaccccgcgccccgacgaugggucgaucaccggccccugcgaguccaacggcgacaaggggagcggcgggaucaagggcggguucguccaccagcggauggaguccaagaucggccgcugguacagucggacgauguccaagaccgagcgcaugggcauggggcuguacgugaaguacgacggcgaccccugggccgacucggacgcccuggcguuuuccggggugauggucagcaugaaggagccgggcugguacuccuucggguucgagaucaaggacaagaagugcgacgugcccuguaucggcaucgagauggugcacgacggcgggaaggagaccuggcacagcgccgccaccgccaucuacugccucaugggcuccgggcagcugcugugggacacggucaccggcguggacauggcccucuga

SEQ ID NO: 30478 - RNA, 1401 nt, Artificial Sequence; identical to SEQ ID NO: 28988
  derived and/or modified CDS sequence (AUadapt) from InfluenzaB__AIL95091__NA

SEQ ID NO: 30479 - RNA, 1401 nt, Artificial Sequence; identical to SEQ ID NO: 28686
  derived and/or modified CDS sequence (AUadapt) from InfluenzaB__AIL95102__NA

SEQ ID NO: 30480 - RNA, 1401 nt, Artificial Sequence
  derived and/or modified CDS sequence (AUadapt) from InfluenzaB__AIL95113__NA
augcugcccaguaccauccagacccucacgcuguuccugaccuccggcggggugcuccugagccuguacgucuccgccagccucuccuaccugcuguauagcgacauccuccugaaguucuccccgaccggcaucaccgcccccacgaugccccuggacugcgcgaaugccucgaacgugcaggccgugaaccgcuccgccaccaagggggucacccuccugcccccggagcccgaguggaccuacccccggcugagcugucccggcuccacguuccagaaggcccuccugaucagcccgcaccgcuucggggagaccaagggcaacuccgcgccccugaucauccgggagcccuuuaucgccugcggccccaacgagugcaagcacuucgcccucacccacuaugccgcgcagcccgggggcuacuacaacgggacccgcggcgaccggaacaagcugcgccaucugaucagcgugaagcucgggaagauccccacgguggagaacuccaucuuccacauggccgccuggagcggcuccgccugucacgacggcaaggaguggaccuacaucggggucgacggccccgacaauaacgcccugcugaaggugaaguacggggaggcguacaccgacaccuaccauucguacgccaacaagauccuccggacgcaggaguccgccugcaacugcaucggcggcaauugcuaccugaugaucaccgacgggagcgccagcggcguguccgagugucgcuuccugaagauccgggaggggcgcaucaucaaggagaucuuccccaccggccgggucaagcacaccgaggagugcacgugcggguuugccagcaacaagaccaucgagugcgcgugccgcgacaaucgguacaccgccaagcgcccguucgugaagcucaacguggagaccgacacggccgagauccggcugaugugcaccgauaccuaccuggacaccccgcgccccaacgacggcuccaucacgggccccugcgagagcgauggggacaagggcuccgggggcaucaagggcggguucguccaccagcggaugaaguccaagaucggccgcugguacucgcggaccaugaguaagaccgagcgcauggggaugggccucuacgugaaguacgacggggacccgugggccgacuccgaugcccuggcguucagcggcgugauggucuccaugaaggagcccgggugguacagcuucggcuuugagaugaaggacaagaagugcgacgugcccugcaucggcaucgagauggugcacgaugggggcaaggagaccuggcacuccgccgccacggccaucuacugccugauggggagcggccagcuccugugggacaccgucaccggcguggacauggcccuguga

SEQ ID NO: 30481 - RNA, 1401 nt, Artificial Sequence; identical to SEQ ID NO: 30427
  derived and/or modified CDS sequence (AUadapt) from InfluenzaB__AIL95124__NA

SEQ ID NO: 30482 - RNA, 1401 nt, Artificial Sequence
  derived and/or modified CDS sequence (AUadapt) from InfluenzaB__AKA54777__NA
augcugcccaguaccauccagacccucacgcuguuccugaccuccggcggggugcuccugagccuguacgucuccgccagccucuccuaucugcuguacagcgacauccuccugaaguucucccgcaccgaggugaccgccccgaucaugccccuggacugugcgaacgccagcaacgugcaggccgucaaccgguccgccacgaagggcgugacgccccuccugcccgagccggaguggaccuacccccgccugaguugccccggguccaccuuccagaaggcccuccugaucucgccccaccgguuuggcgagaccaaggggaacuccgcgccgcugaucauccgcgagcccuucaucgccugcggccccaaggagugcaagcacuuugcccucacccacuacgccgcgcagcccggcggguacuacaacggcacccgggaggaucgcaacaagcugcggcaccugaucagcgugaagcucgggaagaucccgaccgucgagaacuccaucuuucacauggccgccuggagcggcuccgccugccacgacgggcgcgaguggacguauaucggcguggacggccccgacagcaacgcccugcugaagaucaaguacggggaggcguauaccgacaccuaccacuccuacgccaagaauauccuccggacccaggagagcgccugcaacugcaucggcggggacuguuaccugaugaucacggacggccccgccagcggcaucuccgagugccgcuuccugaagauccgggaggggcgcaucaucaaggagaucuuucccaccggccgggugaagcacaccgaggagugcacgugcggguucgccaguaacaagaccaucgagugcgcgugccgcgacaacuccuauaccgccaagcggccguucgucaagcucaacguggagaccgacaccgccgagauccgccugaugugcacgaagaccuaccuggauacgccccggcccaacgacggcagcaucaccgggcccugcgaguccgauggcgacgagggcagcgggggcaucaagggcggguucgugcaccagcgcauggccuccaagaccgggcggugguacagucgcaccauguccaagaccaagcggaugggcaugggccucuacgucaaguacgacggggacccguggaccgacagugaggcccuggcgcuguccggcgugauggugagcauggaggagcccgggugguacuccuucggcuucgagaucaaggauaagaagugcgacguccccugcaucgggaucgagauggugcacgacggcggcaagacgaccuggcauagcgccgccaccgccaucuacugccucaugggguccggccagcugcugugggacaccgugacgggggucaacaugacccucuga

SEQ ID NO: 30483 - RNA, 1401 nt, Artificial Sequence
  derived and/or modified CDS sequence (AUadapt) from InfluenzaB__AKA54781__NA
augcugcccaguaccauccagacccucacgcuguuccugaccuccggcggggugcuccugagccuguacgucuccgccucgcucuccuaccugcuguaccucgacauccugcugaaguuuccgagcaccgagaucaccgcccccacgaugccccucgacugcgcgaacgccuccaacgugcaggccgugaaccgcucggccaccaagggcgucaccuuccugcugcccgagccggaguggaccuauccccggcucuccugccccgggagcacguuccagaaggcccugcugaucagcccccaccgcuucggcgagaccaaggggaacuccgcgccgcucaucauccgggagcccuucaucgccuguggccccaaggagugcaagcacuucgcccugacccacuacgccgcgcagcccggcggguacuacaacggcacccgcggggaucggaacaagcugcgccaccucaucuccgugaagcugggcaagaucccgacgguggagaacucgaucuuccacauggccgccugguccgggagcgccugucacgacggcaaggaguggaccuacaucggcgucgacgggcccgacaacaacgcccugcucaagaucaaguacggcgaggcguauaccgacaccuaccacuccuacgccaacaacauccugcggacgcaggagucggccugcaauugcaucgggggcaacugcuaccugaugaucaccgacggcuccgccagcggggugucggagugccgcuuucucaagauccgggagggccgcaucaugaaggagaucuuccccaccgggcggacccagcacacggaggagugcacgugcggcuucgccuccaacaagaccaucgagugcgugugccgcgauaacagcuacaccgcgaagcggcccuucgucaagcugaacguggagaccgacaccgccgagauccgccugaugugcaccaagaccuaucucgacacgccgcggcccgacgacggguccaucaccggccccugcgagagcaacggcgggaagggcuccgggggcaucaagggcggguucgugcaccagcgcauggccaguaagaucggccggugguacucccgcaccaugagcaagaccgagcggaaggggaugggccuguacgucaaguacaacggggaccccugggccgacuccgacgcccugacguuuucgggcgugaugguguccauggaggagccggggugguacagcuucggcuucgagaucaaggacaagaagugcgacguccccuguaucggcaucgagauggugcacgacgggggcaaggagaccuggcacuccgcggccaccgccaucuacugccucauggggagcggccagcugcugugggacaccgugacgggcgucaacaugacccucuga

SEQ ID NO: 30484 - RNA, 1401 nt, Artificial Sequence
  derived and/or modified CDS sequence (AUadapt) from InfluenzaB__AKA54783__NA
augcugcccaguaccauccagacccucacgcuguuccugaccuccggcggggugcuccugagccuguacgucuccgccagccucuccuaccugcuguauagcgacauccuccugaaguucucccgcaccgaggugaccgccccgaucaugccccuggacugcgcgaaugccagcaacgugcaggccgucaaccgguccgccacgaagggcgugacgccccucuuccccgagccggaguggaccuacccccgccugaguugccccggguccaccuuccagaaggcccugcucaucucgccccaccgguucggcgagaccaaggggaacuccgcgccgcugaucauccgcgagcccuuuaucgccugcggccccaaggagugcaagcacuucgcccugacccacuaugccgcgcagcccggcggguacuacaacggcacccgggaggaccgcaacaagcuccggcaucugaucagcgugaagcuggggaagaucccgaccgucgagaacuccaucuuccacauggccgccuggagcggcuccgccugccaugacgggcgcgaguggacguacaucggcguggacggccccgacagcaaugcccuccugaagaucaaguacggggaggcguacaccgacaccuaccacuccuaugccaagaacauccugcggacccaggagagcgccugcaacugcaucggcggggacuguuaccucaugaucacggacggccccgccagcggcaucuccgagugccgcuuccugaagauccgggaggggcgcaucaucaaggagaucuuucccaccggccgggugaagcacaccgaggagugcacgugcggguucgccucgaauaagaccaucgagugcgcgugccgcgacaacuccuacaccgccaagcggccguucgucaagcugaauguggagaccgacaccgccgagauccgccucaugugcacgaagaccuaccuggacacgccccggcccaacgauggcagcaucaccgggcccugcgaguccgacggcgacgagggcagcgggggcaucaagggcggguuugugcaccagcgcauggccuccaagaucgggcggugguacagccgcaccauguccaagaccaagcggaugggcaugggccuguacgucaaguacgacggggauccguggaccgacagcgaggcccucgcgcuguccggcgugauggugagcauggaggagcccgggugguacuccuucggcuuugagaucaaggacaagaagugcgacguccccugcaucgggaucgagauggugcacgauggcggcaagaccacguggcacagcgccgccaccgccaucuacugccugaugggguccggccagcuccugugggacaccgugaccggggucaacaugacgcuguga

SEQ ID NO: 30485 - RNA, 1401 nt, Artificial Sequence
  derived and/or modified CDS sequence (AUadapt) from InfluenzaB__AKA54785__NA
augcugcccaguaccauccagacccucacgcuguuccugaccuccggcggggugcuccugagccuguacgucuccgccagccucuccuaccugcuguauagcgacauccuccugaaguucucccgcaccgaggugaccgccccgaucaugccccuggacugcgcgaaugccucgaacgugcaggccgucaaccgguccgccacgaagggcgugacgccccuccugcccgagccggaguggaccuacccccgccugagcugucccggguccaccuuccagaaggcccuccugaucagcccccaccgguucggcgagaccaaggggaacuccgcgccgcugaucauccgcgagcccuucaucgccuguggccccaaggagugcaagcacuucgcccucacccacuacgccgcgcagcccggcggguauuacaacggcacccgggaggaccgcaacaagcugcggcaccugaucagugugaagcucgggaagaucccgaccgucgagaacuccaucuuccacauggccgccuggagcggcuccgccugccaugacgggcgcgaguggacguacaucggcguggacggccccgacucgaacgcccugcugaagaucaaguauggggaggcguacaccgacaccuaccacuccuacgccaagaauauccuccggacccaggagagcgccugcaacugcaucggcggggacuguuaccugaugaucacggacggccccgccagcggcaucuccgagugccgcuuccugaagauccgggaggggcgcaucaucaaggagaucuuucccaccggccgggugaagcacaccgaggagugcacgugcggguucgccagcaacaagaccaucgagugugcgugccgcgacaacuccuacaccgccaagcggccguucgucaagcucaauguggagaccgacaccgccgagauccgccugaugugcacgaagaccuaccuggacacgccccggcccaacgauggcagcaucaccgggcccugcgaguccgacggcaacgagggcucggggggcaucaagggcggguuugugcaccagcgcauggccuccaagaucgggcggugguacagccgcaccauguccaagaccaagcggaugggcaugggccucuacgucaaguacgacggggauccguggaccgacagcgaggcccuggcgcuguccggcgugauggugagcauggaggagcccgggugguacuccuucggcuuugagaucaaggacaagaagugcgacguccccugcaucgggaucgagauggugcacgauggcggcaagaccacguggcacagcgccgccaccgccaucuacugccucaugggguccggccagcugcugugggacaccgugaccggggucaacaugacgcucuga

SEQ ID NO: 30486 - RNA, 1401 nt, Artificial Sequence; identical to SEQ ID NO: 28669
  derived and/or modified CDS sequence (AUadapt) from InfluenzaB__AKA54787__NA

SEQ ID NO: 30487 - RNA, 1401 nt, Artificial Sequence; identical to SEQ ID NO: 28646
  derived and/or modified CDS sequence (AUadapt) from InfluenzaB__AKA54789__NA

SEQ ID NO: 30488 - RNA, 1401 nt, Artificial Sequence
  derived and/or modified CDS sequence (AUadapt) from InfluenzaB__AKA54791__NA
augcugcccaguaccauccagacccucacgcuguuccugaccuccggcggggugcuccugagccuguacgucuccgccagccucuccuaucugcuguacagcgacauccuccugaaguucucccgcaccgaggugaccgccccgaucaugccccuggacugugcgaacgccagcaacgcccaggccgugaaccgguccgccacgaagggcgucacgccccuccugcccgagccggaguggaccuacccccgccugaguugccccggguccaccuuccagaaggcgcuccugaucucgccccaccgguuuggcgagaccaaggggaacuccgccccgcugaucauccgcgagcccuucaucgccugcggccccaaggagugcaagcacuuugcccucacccacuacgcggcccagcccggcggguacuacaacggcacccgggaggaucgcaacaagcugcggcaccugaucagcgugaagcucgggaagaucccgaccguggagaacuccaucuuucacauggccgccuggagcggcuccgccugccacgacgggcgcgaguggacguauaucggcgucgacggccccgacagcaacgcgcugcugaagaucaaguacggggaggccuauaccgacaccuaccacuccuacgccaagaauauccuccggacccaggagagcgccugcaacugcaucggcggggacuguuaccugaugaucacggacggccccgccagcggcaucuccgagugccgcuuccugaagauccgggaggggcgcaucaucaaggagaucuuucccaccggccgggugaagcacaccgaggagugcacgugcggguucgcgaguaacaagaccaucgagugcgccugccgcgacaacuccuauaccgccaagcggccguucgugaagcucaacgucgagaccgacaccgccgagauccgccugaugugcacgaagaccuaccuggauacgccccggcccaacgacggcagcaucaccgggcccugcgaguccgauggcgacgagggcagcgggggcaucaagggcggguucgugcaccagcgcauggccuccaagaucgggcggugguacagucgcaccauguccaagaccaagcggaugggcaugggccucuacgugaaguacgacggggacccguggaccgacagugaggcgcuggcccuguccggcgucauggugagcauggaggagcccgggugguacuccuucggcuucgagaucaaggauaagaagugcgacgugcccugcaucgggaucgagaugguccacgacggcggcaagaccacguggcauagcgccgccaccgccaucuacugccucaugggguccggccagcugcugugggacaccgugaccggggugaacaucacgcucuga

SEQ ID NO: 30489 - RNA, 1401 nt, Artificial Sequence; identical to SEQ ID NO: 28669
  derived and/or modified CDS sequence (AUadapt) from InfluenzaB__AKA54793__NA

SEQ ID NO: 30490 - RNA, 1401 nt, Artificial Sequence; identical to SEQ ID NO: 28669
  derived and/or modified CDS sequence (AUadapt) from InfluenzaB__AKA54795__NA

SEQ ID NO: 30491 - RNA, 1401 nt, Artificial Sequence; identical to SEQ ID NO: 28646
  derived and/or modified CDS sequence (AUadapt) from InfluenzaB__AKA54797__NA

SEQ ID NO: 30492 - RNA, 1401 nt, Artificial Sequence
  derived and/or modified CDS sequence (AUadapt) from InfluenzaB__AKA54799__NA
augcugcccaguaccauccagacccucacgcuguuccugaccuccggcggggugcuccugagccuguacgucuccgccagccucuccuaccugcuguauagcgacauccuccugaaguucucccagaccgagaucaccgccccgaucaugccccuggacugcgcgaacgccaguaacgugcaggccgugaaccacuccgccgccaagggcgucacgcuccugcugcccgagcccgaguggaccuacccgcgccucagcugccccggguccaccuuucagaaggcgcugcugaucagcccccaccgguucggcgagaucaaggggaacuccgcgccccucaucauccgcgagccguucaucgccuguggccccaccgagugcaagcacuucgcccugacgcacuacgccgcccagcccggcggguacuauaacggcacccgggaggaccgcaacaagcugcggcaccucaucagcgugaagcuggggaagauccccaccguggagaacuccaucuuucacauggccgccuggagcggcuccgccugccacgacgggaaggaguggaccuauaucggcgucgacggcccggacucgaacgcgcugcucaagaucaaguacggggaggccuacacggauaccuaccacuccuacgagaagaacauccugcgcacccaggagagcgccugcaauugcaucggcggggacugcuaccugaugaucaccgacggccccgccaguggcguguccgagugccgguuccucaagauccgcgaggggcggaucaucaaggagaucuuccccacgggccgcgugaagcacaccgaggagugcacgugcggguuugccagcaacaagaccaucgagugcgcgugccgggacaaccgcuauaccgccaagcggcccuucgucaagcugaacguggagaccgacaccgccgagauccgccugaugugcaccgagacguaccucgauaccccgcggcccaacgacggcuccaucaccgggcccugcgagagcgacggcgacaagggcuccgggggcaucaagggcggguuugugcaccagcgcauggccucgaagaucgggcggugguacucccgcaccaugagcaagacgaagcggaugggcaugggccuguacgucaaguacgauggggaccccuggaccgacuccgaggcccuggcgcucagcggcgugaugguguccauggaggagccggggugguacagcuuuggcuucgagaucaaggacaagaagugcgacguccccugcaucgggaucgagauggugcacgauggcggcaagaccaccuggcacuccgccgccacggccaucuacugccugauggggagcggccagcugcucugggacaccgugaccggggucgacauggcccuguga

SEQ ID NO: 30493 - RNA, 1401 nt, Artificial Sequence; identical to SEQ ID NO: 28646
  derived and/or modified CDS sequence (AUadapt) from InfluenzaB__AKA54801__NA

SEQ ID NO: 30494 - RNA, 1401 nt, Artificial Sequence
  derived and/or modified CDS sequence (AUadapt) from InfluenzaB__AKA54803__NA
augcugcccaguaccauccagacccucacgcuguuccugaccuccggcggggugcuccugagccuguacgucuccgccagccucuccuaccugcuguauagcgacauccuccugaaguucucccgcaccgaggugaccgccccgaucaugccccuggacugcgcgaaugccagcaacgugcaggccgucaaccgguccgccacgaacggcgugacgccccuccugcccgagccggaguggaccuacccccgccugaguugccccggguccaccuuccagaaggcccuccugaucucgccccaccgguucggcgagaccaaggggaauuccgcgccgcugaucauccgcgagcccuucaucgccugcggccccaaggagugcaagcacuucgcccucacccauuacgccgcgcagcccggcggguacuacaacggcacccgggaggaccgcaauaagcugcggcaccugaucagcgugaagcucgggaagaucccgaccgucgagaacuccaucuuccacauggccgccuggaguggcuccgccugccacgacgggcgcgaguggacguacaucggcguggacggccccgauagcaacgcccugcugaagaucaaguacggggaggcguacaccgacaccuaucacuccuacgccaagaacauccuccggacccaggagagcgccugcaauugcaucggcggggacugcuaccugaugaucacggacggccccgccaguggcaucuccgagugccgcuuccugaagauccgggaggggcgcaucaucaaggagaucuuccccaccggccgggugaagcacaccgaggagugcacguguggguucgccucgaacaagaccaucgagugcgcgugccgcgauaacuccuacaccgccaagcggccguucgucaagcucaacguggagaccgacaccgccgagauccgccugauguguacgaagaccuaccuggacacgccccggcccaacgacggcagcaucaccgggcccugugaguccgacggcgacgagggcagcgggggcaucaagggcggguucgugcaccagcgcauggccuccaagaucgggcggugguauagccgcaccauguccaagaccaagcggaugggcaugggccucuacgucaaguacgacggggacccguggaccgauagcgaggcccuggcgcuguccggcgugauggugagcauggaggagcccgggugguacuccuucggcuucgagaucaaggauaagaagugcgacguccccugcaucgggaucgagauggugcacgacggcggcaagaccacguggcauagcgccgccaccgccaucuacugccucaugggguccggccagcugcugugggacaccgugaccggggucaacaugacgcucuga

SEQ ID NO: 30495 - RNA, 1401 nt, Artificial Sequence; identical to SEQ ID NO: 28646
  derived and/or modified CDS sequence (AUadapt) from InfluenzaB__AKA54805__NA

SEQ ID NO: 30496 - RNA, 1401 nt, Artificial Sequence
  derived and/or modified CDS sequence (AUadapt) from InfluenzaB__AKA54807__NA
augcugcccaguaccauccagacccucacgcuguuccugaccuccggcggggugcuccugagccuguacgucuccgccagccucuccuaucugcuguacagcgacauccuccugaaguucucccgcaccgaggugaccgccccgaucaugccccuggacugugcgaacgccagcaacgugcaggccgucaaccgguccgccacgaagggcgugacgccccuccugcccgagccggaguggaccuacccccgccugaguugccccggguccaccuuccagaaggcccuccugaucucgccccaccgguucggcgagaccaaggggaauuccgcgccgcugaucauccgcgagcccuucaucgccugcggccccaaggagugcaagcacuucgcccucacccauuacgccgcgcagcccggcggguacuacaacggcacccgggaggaccgcaauaagcugcggcaccugaucagcgugaagcucgggaagaucccgaccgucgagaacuccaucuuccacauggccgccuggaguggcuccgccugccacgacgggcgcgaguggacguacaucggcguggacggccccgauagcaacgcccugcugaagaucaaguacggggaggcguacaccgacaccuaucacuccuacgccaagaacauccuccggacccaggagagcgccugcaauugcaucggcggggacugcuaccugaugaucacggacggccccgccaguggcaucuccgagugccgcuuccugaagauccgggaggggcgcaucaucaaggagaucuuccccaccggccgggugaagcacaccgaggagugcacguguggguucgccucgaacaagaccaucgagugcgcgugccgcgauaacuccuacaccgccaagcggccguucgucaagcucaacguggagaccgacaccgccgagauccgccugauguguacgaagaccuaccuggacacgccccggcccaacgacggcagcaucaccgggcccugugaguccgacggcgacgagggcagcgggggcaucaagggcggguucgugcaccagcgcauggccuccaagaucgggcggugguauagccgcaccauguccaagaccaagcggaugggcaugggccucuacgucaaguacgacggggacccguggaccgauagcgaggcccuggcgcuguccggcgugauggugagcauggaggagcccgggugguacuccuucggcuucgagaucaaggauaagaagugcgacguccccugcaucgggaucgagauggugcacgacggcggcaagaccacguggcauagcgccgccaccgccaucuacugccucaugggguccggccagcugcugugggacaccgugaccggggucaacaucacgcucuga

SEQ ID NO: 30497 - RNA, 1401 nt, Artificial Sequence
  derived and/or modified CDS sequence (AUadapt) from InfluenzaB__AKA54809__NA
augcugcccaguaccauccagacccucacgcuguuccugaccuccggcggggugcuccugagccuguacgucuccgccagccucuccuaccugcuguauagcgacauccuccugaaguucucccgcaccgaggugaccgccccgaucaugccccuggacugcgcgaaugccagcaacgugcaggccgucaaccgguccgccacgaagggcgugacgccccuccugcccgagccggaguggaccuacccccgccugagcugucccggguccaccuuccagaaggcccuccugaucucgccccaccgguucggcgagaccaaggggaacuccgcgccgcugaucauccgcgagcccuucaucgccuguggccccaaggagugcaagcacuucgcccucacccacuacgccgcgcagcccggcggguauuacaacggcacccgggaggaccgcaacaagcugcggcaccugaucagugugaagcucgggaagaucccgaccgucgagaacuccaucuuccacauggccgccuggagcggcuccgccugccacgaugggcgcgaguggacguacaucggcguggacggccccgacagcaacgcccugcugaagaucaaguauggggaggcguacaccgacaccuaccacuccuacgccaagaauauccuccggacccaggagagcgccugcaacugcaucggcggggacugcuaucugaugaucacggacggccccgccagcggcaucuccgagugccgcuuccugaagauccgggaggggcgcaucaucaaggagaucuuccccaccggccgggugaagcauaccgaggagugcacgugcggguucgccucgaacaagaccaucgagugugcgugccgcgacaacuccuacaccgccaagcggccguucgucaagcucaacguggagaccgauaccgccgagauccgccugaugugcacgaagaccuaccuggacacgccccggcccaacgacggcaguaucaccgggcccugcgaguccgacggcgacgagggcagcgggggcaucaagggcggguucgugcaucagcgcauggccuucaagaucgggcggugguacucccgcaccaugagcaagaccaagcggaugggcaugggccucuacgucaaguacgacggggauccguggaccgacuccgaggcccuggcgcugagcggcgugaugguguccauggaggagcccgggugguacagcuucggcuuugagaucaaggacaagaagugcgacguccccugcaucgggaucgagauggugcacgauggcggcaagaccacguggcacuccgccgccaccgccaucuacugccucauggggagcggccagcugcugugggacaccgugaccggggucaacaugacgcucuga

SEQ ID NO: 30498 - RNA, 1401 nt, Artificial Sequence; identical to SEQ ID NO: 28646
  derived and/or modified CDS sequence (AUadapt) from InfluenzaB__AKA54811__NA

SEQ ID NO: 30499 - RNA, 1401 nt, Artificial Sequence
  derived and/or modified CDS sequence (AUadapt) from InfluenzaB__AKA54813__NA
augcugcccaguaccauccagacccucacgcuguuccugaccuccggcggggugcuccugagccuguacgucuccgccagccucuccuaucugcuguacagcgacauccuccugaaguucucccgcaccgaggugaccgccccgaucaugccccuggacugugcgaacgccagcaacgugcaggccgucaaccgguccgccacgaagggcgugacgccccuccugcccgagccggaguggaccuacccccgccugaguugccccggguccaccuuccagaaggcccuccugaucucgccccaccgguucggcgagaccaaggggaauuccgcgccgcugaucauccgcgagcccuucaucgccugcggccccaaggagugcaagcacuucgcccucacccauuacgccgcgcagcccggcggguacuacaacggcacccgggaggaccgcaauaagcugcggcaccugaucagcgugaagcucgggaagaucccgaccgucgagaacuccaucuuccacauggccgccuggaguggcuccgccugccacgacgggcgcgaguggacguacaucggcguggacggccccgauagcaacgcccugcugaagaucaaguacggggaggcguacaccgacaccuaucacuccuacgccaagaacauccuccggacccaggagagcgccugcaauugcaucggcggggacugcuaccugaugaucacggacggccccgccaguggcaucuccgagugccgcuuccugaagauccgggaggggcgcaucaucaaggagaucuuccccaccggccgggugaagcacaccgaggagugcacguguggguucgccucgaacaagaccaucgagugcgcgugccgcgauaacuccuacaccgccaagcggccguucgucaagcucaacguggagaccgacaccgccgagauccgccugauguguacgaagaccuaccuggacacgccccggcccaacgacggcagcaucaccgggcccugugaguccgacggcgacgagggcagcgggggcaucaagggcggguucgugcaccagcgcauggccuccaagaucgggcggugguauagccgcaccauguccaagaccaagcggaugggcaugggccucuacgucaaguacgacggggacccguggaccgauagcgaggcccuggcgcuguccggcgugauggugagcaucgaggagcccgggugguacuccuucggcuucgagaucaaggauaagaagugcgacguccccugcaucgggaucgagauggugcacgacggcggcaagaccacguggcauagcgccgccaccgccaucuacugccucaugggguccggccagcugcugugggacaccgugaccggggucaacaugacgcucuga

SEQ ID NO: 30500 - RNA, 1401 nt, Artificial Sequence; identical to SEQ ID NO: 28646
  derived and/or modified CDS sequence (AUadapt) from InfluenzaB__AKA54815__NA

SEQ ID NO: 30501 - RNA, 1401 nt, Artificial Sequence
  derived and/or modified CDS sequence (AUadapt) from InfluenzaB__AKA54817__NA
augcugcccaguaccauccagacccucacgcuguuccugaccuccggcggggugcuccugagccuguacgucuccgccagccucuccuaucugcuguacagcgacauccuccugaaguucucccgcaccgaggugaccgccccgaucaugccccuggacugugcgaacgccagcaacgugcaggccgucaaccgguccgccacgaagggcgugacgccccuccugcccgagccggaguggaccuacccccgccugaguugccccggguccaccuuccagaaggcccuccugaucagcccccaccgguuuggcgagaccaaggggaacuccgcgccgcugaucauccgcgagcccuucaucgccugcggccccaaggagugcaagcacuuugcccucacccacuacgccgcgcagcccggcggguacuacaacggcacccgggaggaucgcaacaagcugcggcaccugaucagcgugaagcucgggaagaucccgaccgucgagaacuccaucuuucacauggccgccuggagcggcuccgccugccacgacgggcgcgaguggacguauaucggcguggacggccccgacucgaacgcccugcugaagaucaaguacggggaggcguauaccgacaccuaccacuccuacgccaagaauauccuccggacccaggagagcgccugcaacugcaucggcggggacuguuaccugaugaucacggacggccccgccagcggcaucuccgagugccgcuuccugaagauccgggaggggcgcaucaucaaggagaucuuucccaccggccgggugaagcacaccgaggagugcacgugcggguucgccaguaacaagaccaucgagugcgcgugccgcgacaacuccuauaccgccaagcggccguucgucaagcucaacguggagaccgacaccgccgagauccgccugaugugcacgaagaccuaccuggauacgccccggcccaacgacggcagcaucaccgggcccugcgaguccgauggcgacgagggcagcgggggcaucaagggcggguucgugcaccagcgcauggccuccaagaucgggcggugguacagucgcaccauguccaagaccaagcggaugggcaugggccucuacgucaaguacgacggggacccguggaccgacagugaggcccuggcgcuguccggcgugauggugagcauggaggagcccgggugguacuccuucggcuucgagaucaaggauaagaagugcgacguccccugcaucgggguggagauggugcacgacggcggcaagaccacguggcauagcgccgccaccgccaucuacugccucaugggguccggccagcugcugugggacaccgucaccggggugaacaugacgcucuga

SEQ ID NO: 30502 - RNA, 1401 nt, Artificial Sequence; identical to SEQ ID NO: 28646
  derived and/or modified CDS sequence (AUadapt) from InfluenzaB__AKA54819__NA

SEQ ID NO: 30503 - RNA, 1401 nt, Artificial Sequence; identical to SEQ ID NO: 28646
  derived and/or modified CDS sequence (AUadapt) from InfluenzaB__AKA54821__NA

SEQ ID NO: 30504 - RNA, 1401 nt, Artificial Sequence; identical to SEQ ID NO: 28646
  derived and/or modified CDS sequence (AUadapt) from InfluenzaB__AKA54823__NA

SEQ ID NO: 30505 - RNA, 1401 nt, Artificial Sequence; identical to SEQ ID NO: 28646
  derived and/or modified CDS sequence (AUadapt) from InfluenzaB__AKA54825__NA

SEQ ID NO: 30506 - RNA, 1401 nt, Artificial Sequence; identical to SEQ ID NO: 28646
  derived and/or modified CDS sequence (AUadapt) from InfluenzaB__AKA54827__NA

SEQ ID NO: 30507 - RNA, 1401 nt, Artificial Sequence
  derived and/or modified CDS sequence (AUadapt) from InfluenzaB__AKA54829__NA
augcugcccaguaccauccagacccucacgcuguuccugaccuccggcggggugcuccugagccuguacgucuccgccagccucuccuaucugcuguacagcgacauccuccugaagcugucccgcaccgaggugaccgccccgaucaugccccucgacugcgcgaaugccucgaacgugcaggccgucaaccgguccgccacgaagggcgugacgccccugcugcccgagccggaguggaccuacccccgccucagcugucccggguccaccuuccagaagacccugcugaucagcccccaccgguucggcgagaccaaggggaacuccgccccgcucaucauccgcgagcccuuuaucgcgugcggccccaaggagugcaagcacuucgcccugacccacuaugccgcccagcccggcggguacuacaacggcacccgggaggaccgcaacaagcugcggcaucucaucagcgugaagcuggggaagaucccgacggucgagaacuccaucuuccacauggcggccuggagcggcuccgccugucacgacgggcgcgaguggaccuacaucggcguggacggccccgacaguaacgcccugcucaagaucaaguacggggaggccuacaccgacaccuaccauuccuacgcgaagaacauccugcggacgcaggagagcgccugcaacuguaucggcggggacugcuaccugaugaucaccgacggccccgccaguggcaucuccgagugccgcuuccucaagauccgggaggggcgcaucaucaaggagaucuuccccaccggccgggugaagcacaccgaggagugcacguguggguucgccagcaacaagaccaucgagugcgccugccgcgauaacuccuacaccgcgaagcggccguucgucaagcugaacguggagaccgacacggccgagauccgccugauguguaccaagaccuaccucgacacgccccggcccaacgacggcagcaucaccgggcccugugaguccgacggcgacgagggcucggggggcaucaagggcggguucgugcaccagcgcauggccuccaagaucgggcggugguauagccgcaccauguccaagaccaagcggaugggcaugggccuguacgucaaguacgacggggacccguggaccgauagcgaggcccuggcccucuccggcgugauggugagcauggaggagcccgggugguacuccuucggcuucgagaucaaggauaagaagugcgacguccccugcaucgggaucgagauggugcacgacggcggcaagacgaccuggcauagcgcggccaccgccaucuacugccugaugggguccggccagcugcucugggacaccgugacgggggucaacaugacccuguga

SEQ ID NO: 30508 - RNA, 1401 nt, Artificial Sequence
  derived and/or modified CDS sequence (AUadapt) from InfluenzaB__AKA54831__NA
augcugcccaguaccauccagacccucacgcuguuccugaccuccggcggggugcuccugagccuguacgucuccgccagccucuccuaccugcuguauagcgacauccuccugaaguucucccgcaccgaggugaccgccccgaucaugccccuggacugcgcgaaugccucgaacgugcaggccgucaaccgguccgccacgaagggcgugacgccccuccugcccgagccggaguggaccuacccccgccugagcugucccggguccaccuuccagaaggcccuccugaucagcccccaccgguucggcgagaccaaggggaacuccgcgccgcugaucauccgcgagcccuucaucgccuguggccccaaggagugcaagcacuucgcccucacccacuacgccgcgcagcccggcggguauuacaacggcacccgggaggaccgcaacaagcugcggcaccugaucagugugaagcucgggaagaucccgaccgucgagaacuccaucuuccacauggccgccuggagcggcuccgccugccaugacgggcgcgaguggacguacaucggcguggacggccaggacucgaacgcccugcugaagaucaaguauggggaggcguacaccgacaccuaccacuccuacgccaagaauauccuccggacccaggagagcgccugcaacugcaucggcggggacuguuaccugaugaucacggacggccccgccagcggcaucuccgagugccgcuuccugaagauccgggaggggcgcaucaucaaggagaucuuucccaccggccgggugaagcacaccgaggagugcacgugcggguucgccagcaacaagaccaucgagugugcgugccgcgacaacuccuacaccgccaagcggcccuucgucaagcucaauguggagaccgacaccgccgagauccgccugaugugcacgaagaccuaccuggacaccccgcggcccaacgauggcagcaucaccgggcccugcgaguccgacggcgacgagggcucggggggcaucaagggcggguuugugcaccagcgcauggccuccaagaucgggcggugguacagccgcacgauguccaagaccaagcggaugggcaugggccucuacgucaaguacgacggggaucccuggaccgacagcgaggcccuggcgcuguccggcgugauggugagcauggaggagccggggugguacuccuucggcuuugagaucaaggacaagaagugcgacguccccugcaucgggaucgagauggugcacgauggcggcaagaccacguggcacagcgccgccaccgccaucuacugccucaugggguccggccagcugcugugggacaccgugaccggggucaacaugacgcucuga

SEQ ID NO: 30509 - RNA, 1401 nt, Artificial Sequence; identical to SEQ ID NO: 28646
  derived and/or modified CDS sequence (AUadapt) from InfluenzaB__AKA54833__NA

SEQ ID NO: 30510 - RNA, 1401 nt, Artificial Sequence
  derived and/or modified CDS sequence (AUadapt) from InfluenzaB__AKA54837__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuucagaaggcccugcugaucagcccccaccgcuucggcgagaccaacgggaacuccgcgccgcucaucgugcgggagcccuucaucgccuguggccccaacgagugcaagcacuucgcccugacccacuaugccgcgcagcccggcggguacuacaacggcacccgcggggaccggaacaagcugcgccaccucaucagugugaagcugggcaagaucccgacggucgagaacuccaucuuccacauggccgccuggagcggguccgccugccacgauggcaaggaguggaccuacaucggcguggacgggcccgacaacaacgcccugcucaaggugaaguauggcgaggcguacaccgacaccuaccacucguacgccaauaagauccugcggacgcaggaguccgccugcaacugcaucgggggcaacugcuaucugaugaucaccgacggcagcgccagcggggucuccgagugccgcuuccucaagauccgggagggccgcaucaucaaggagaucuuccccaccgggcgggugaagcauaccgaggagugcacgugcggcuucgccagcaacaagaccaucgagugugcgugccgcgacaaccgguacaccgccaagcgccccuucgugaagcugaacgucgagaccgauacggccgagauccggcugaugugcaccgacaccuaccucgacaccccgcgccccaacgacggguccaucacgggccccugugagagcgacggcaacgagggguccggcgggaucaagggcggguucgugcaccagcggaugaaguccaagaucggccgcugguauucgcggaccaugagcaagaccgagcgcaugggcauggggcuguacgugaaguacgacggcgaccccugggccgauuccgacgcccuggcguucagcggggucaugguguccaugaaggagccgggcugguacagcuuuggguucgagaucaaggacaagaagugcgacgugcccugcaucggcaucgagaugguccacgauggcgggaaggagaccuggcacuccgccgccacggccaucuacugccucaugggcagcgggcagcugcugugggacaccgugaccggcguggacauggcccucuga

SEQ ID NO: 30511 - RNA, 1401 nt, Artificial Sequence
  derived and/or modified CDS sequence (AUadapt) from InfluenzaB__AKA54839__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccgcuccgccaccaaggaggucacccuccugcugcccgagccggaguggaccuacccccggcucagcugccccggcuccacguuccagaaggcccugcugaucucgccccaucgcuucggggagaccaagggcaacuccgcgccgcucaucauccgggagcccuucaucgccugcgggcccaacgagugcaagcacuuugcccugacccacuacgccgcgcagcccggcggcuacuacaacgggacccgcggcgaccggaauaagcugcgccaccucaucagcgugaagcuggggaagaucccgacgguggagaacuccaucuuccacauggccgccuggagcggcuccgccugucacgacgggaaggaguggaccuacaucggcgucgacggccccgacaacaacgcccugcucaaggugaaguauggggaggcguacaccgacaccuaccacucguacgccaauaagauccugcggacgcaggaguccgccugcaacugcaucggcgggaacugcuaccugaugaucaccgauggcagcgccagcggcguguccgagugccgcuuccucaagauccgggaggggcgcaucaucaaggagaucuuccccaccggccgggucaagcacaccgaggaguguacgugcggguucgccucgaacaagaccaucgagugcgcgugccgcgacaaucgguacaccgccaagcgccccuucgugaagcugaacguggagaccgacacggccgagauccggcugaugugcaccgacaccuaucucgacaccccgcgccccaacgacggcuccaucacggggcccugcgagagcgacggcgauaagggcuccgggggcaucaagggcggguucguccaccagcggaugaaguccaagaucgggcgcugguacagccggaccaugucgaagaccgagcgcaugggcaugggccuguacgugaaguacgauggggaccccugggccgacuccgacgcccuggcguucagcggcgugauggucuccaugaaggagccggggugguacaguuucggcuucgagaucaaggacaagaagugcgacgugcccugcaucgggaucgagauggugcaugacggcggcaaggagaccuggcacuccgccgccacggccaucuacugccucauggggagcggccagcugcugugggacaccgucaccgggguggacauggcccucuga

SEQ ID NO: 30512 - RNA, 1401 nt, Artificial Sequence
  derived and/or modified CDS sequence (AUadapt) from InfluenzaB__AKA54841__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccagcaacgugcaggccgugaaccgcuccgccaccaagggcgucacccuccugcugcccgagccggaguggaccuacccccggcucagcugucccggguccacguuccagaaggcccugcugaucucgccccaccgcuucggcgagaccaaggggaacuccgcgccgcucaucauccgggagcccuuuaucgccugcggccccaacgagugcaagcacuucgcccugacccacuaugccgcgcagcccggcggguacuacaacggcacccgcggggaccggaacaagcugcgccaucucaucagcgugaagcugggcaagaucccgacgguggagaacuccaucuuccacauggccgccuggagcggguccgccugucacgacggcaaggaguggaccuacaucggcgucgacgggcccgacaauaacgcccugcucaaggugaaguacggcgaggcguacaccgacaccuaccauagcuacgccaacaagauccugcggacgcaggaguccgccugcaacugcaucgggggcaauugcuaccugaugaucaccgacggcagcgccagcgggguguccgagugucgcuuccucaagauccgggagggccgcaucaucaaggagaucuuccccaccgggcgggucaagcacaccgaggagugcacgugcggcuuugccucgaacaagaccaucgagugcgcgugccgcgacaaucgguacaccgccaagcgccccuucgugaagcugaacguggagaccgacacggccgagauccggcugaugugcaccgauaccuaccucgacaccccgcgccccaacgacggguccaucacgggccccugcgagagcgauggcgacgagggguccggcgggaucaagggcggguucguccaccagcggaugaaguccaagaucggccgcugguacagccggaccaugaguaagaccgagcgcaugggcauggggcuguacgugaaguacgacggcgaccccugggccgacuccgaugcccuggcguucagcggggugauggucuccgugaaggagccgggcugguacagcuucggguuugagaucaaggacaagaagugcgacgugcccugcaucggcaucgagaugguccacgauggcgggaaggagaccuggcacuccgccgccacggccaucuacugccucaugggcagcgggcagcugcugugggacaccgugaccggcguggacaucgcccucuga

SEQ ID NO: 30513 - RNA, 1401 nt, Artificial Sequence
  derived and/or modified CDS sequence (AUadapt) from InfluenzaB__AKA54843__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccagcaacgugcaggccgugaaccgcuccgccaccaagggcgucacccuccugcugcccgagccggaguggaccuacccccggcucagcugucccggguccacguuccagaaggcccugcugaucucgccccaccgcuucggcgagaccaaggggaacuccgcgccgcucaucauccgggagcccuuuaucgccugcggccccaacgagugcaagcacuucgcccugacccacuaugccgcgcagcccggcggguacuacaacggcacccgcggggaccggaacaagcugcgccaucucaucagcgugaagcugggcaagaucccgacgguggagaacuccaucuuccacauggccgccuggagcggguccgccugucacgacggcaaggaguggaccuacaucggcgucgacgggcccgacaauaacgcccugcucaaggugaaguacggcgaggcguacaccgacaccuaccauagcuacgccaacaagauccugcggacgcaggaguccgccugcaacugcaucgggggcaauugcuaccugaugaucaccgacggcagcgccagcgggguguccgagugucgcuuccucaagauccgggagggccgcaucaucaaggagaucuuccccaccgggcgggucaagcacaccgaggagugcacgugcggcuuugccucgaacaagaccaucgagugcgcgugccgcgacaaucgguacaccgccaagcgccccuucgugaagcugaacguggagaccgacacggccgagauccggcugaugugcaccgauaccuaccucgacaccccgcgccccaacgacggguccaucacgggccccugcgagagcgauggcgacgagggguccggcgggaucaagggcggguucguccaccagcggaugaaguccaagaucggccgcugguacagccggaccaugaguaagaccgagcgcaugggcauggggcuguacgugaaguacgacggcgaccccugggccgacuccgaugcccuggcguucagcggggugauggucuccgugaaggagccgggcugguacagcuucggguuugagaucaaggacaagaagugcgacgugcccugcaucggcaucgagaugguccacgauggcgggaaggagaccuggcacuccgccgccacggccaucuacugccucaugggcagcgggcagcugcugugggacaccgugaccggcguggacauggcccucuga

SEQ ID NO: 30514 - RNA, 1401 nt, Artificial Sequence
  derived and/or modified CDS sequence (AUadapt) from InfluenzaB__AKA54845__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuucagaaggcccugcugaucagcccccaccgcuucggcgagaccaacgggaacuccgcgccgcucaucauccgggagcccuucaucgccuguggccccaacgagugcaagcacuucgcccugacccacuaugccgcgcagcccggcggguacuacaacggcacccgcggggaccggaacaagcugcgccaccucaucagugugaagcugggcaagaucccgacgguggagaacuccaucuuccacauggccgccuggagcggguccgccugccacgauggcaaggaguggaccuacaucggcgucgacgggcccgacaacaacgcccugcucaaggugaaguauggcgaggcguacaccgacaccuaccacucguacgccaauaagauccugcggacgcaggaguccgccugcaacugcaucgggggcaacugcuaucugaugaucaccgacggcagcgccagcgggguguccgagugccgcuuccucaagauccgggagggccgcaucaucaaggagaucuuccccaccgggcgggucaagcauaccgaggagugcacgugcggcuucgccagcaacaagaccaucgagugugcgugccgcgacaaccgguacaccgccaagcgccccuucgugaagcugaacguggagaccgauacggccgagauccggcugaugugcaccgacaccuaccucgacaccccgcgccccaacgacggguccaucacgggccccugugagagcgacggcgacgagggguccggcgggaucaagggcggguucguccaccagcggaugaaguccaagaucggccgcugguauucgcggaccaugagcaagaccgagcgcaugggcauggggcuguacgugaaguacgacggcgaccccugggccgauuccgacgcccuggcguucagcggggugauggucuccaugaaggagccgggcugguacagcuuuggguucgagaucaaggacaagaagugcgacgugcccugcaucggcaucgagauggugcacgauggcgggaaggagaccuggcacuccgccgccacggccaucuacugccucaugggcagcgggcagcugcugugggacaccgucaccggcguggacauggcccucuga

SEQ ID NO: 30515 - RNA, 1401 nt, Artificial Sequence; identical to SEQ ID NO: 28678
  derived and/or modified CDS sequence (AUadapt) from InfluenzaB__AKA54847__NA

SEQ ID NO: 30516 - RNA, 1401 nt, Artificial Sequence
  derived and/or modified CDS sequence (AUadapt) from InfluenzaB__AKA54849__NA
augcugcccaguaccauccagacccucacgcuguuccugaccuccggcggggugcuccugagccuguacgucuccgccagccucuccuaccugcuguauagcgacauccuccugaaguucuccucgaccgagaucaccgccccgacgaugccccuggacugcgcgaaugccuccaacgugcaggccgugaaccgcagcgccaccaagggcgucacccuccugcugcccgagcccgaguggaccuacccgcggcucuccugccccgggaguacguuccagaaggcccugcugaucagcccccaccgcuucggcgagaccaacgggaacagugcgccccucaucauccgggagccguucaucgccugcggccccaacgagugcaagcacuuugcccugacccacuacgccgcgcagcccggcggguacuacaacggcacccgcggggaccggaauaagcugcgccaccucaucuccgugaagcugggcaagauccccacgguggagaacucgaucuuccacauggccgccugguccgggagcgccugucacgacggcaaggaguggaccuacaucggcgucgacgggccggacaauaacgcccugcucaaggugaaguacggcgaggcguacaccgacaccuaccacuccuaugccaacaagauccugcggacgcaggagagcgccugcaacugcaucgggggcaauugcuaccugaugaucaccgacggcagcgccuccggggugagcgagugccgcuuucucaagauccgggagggccgcaucaucaaggagaucuuccccaccgggcgggucaagcacaccgaggagugcacgugcggcuucgccuccaauaagaccaucgagugcgcgugccgcgacaaccgguacaccgccaagcgccccuucgugaagcugaauguggagaccgacacggccgagauccggcugaugugcaccgacaccuaccucgacacgccccgcccgaacgaugggucgaucaccggccccugcgaguccgacggcgacgagggcggcgggggcaucaagggcggguucguccaucagcggaugaaguccaagaucgggcgcugguacucccggaccaugagcaagaccgagcgcauggggaugggccuguacgugaaguacgacggggaccccugggccgauuccgacgcccuggcguucagcggcgugauggucuccaugaaggagcccgggugguacagcuuuggcuucgagaucaaggacaagaagugcgacgugccgugcaucggcaucgagauggugcacgaugggggcaaggagaccuggcacuccgccgccacggccaucuacugccucauggggagcggccagcugcugugggacaccgucaccggcguggacauggcccucuga

SEQ ID NO: 30517 - RNA, 1401 nt, Artificial Sequence
  derived and/or modified CDS sequence (AUadapt) from InfluenzaB__AKA54851__NA
augcugcccaguaccauccagacccucacgcuguuccugaccuccggcggggugcuccugagccuguacgucuccgccagccucuccuaccugcuguacagugacauccuccugaaguucuccccgaccgagaucaccgcccccacgaugccccuggacugcgcgaacgccagcaaugugcaggccgugaaccgcuccgccaccaagggcgucacccuccugcugcccgagccggaguggaccuacccccggcucagcugccccggguccacguuccagaaggcccugcugaucagcccccaucgcuucggcgagaccaaggggaacuccgcgccgcucaucauccgggagcccuucaucgccugcggccccaacgagugcaagcacuuugcccugacccacuacgccgcgcagcccggcggguacuacaacggcacccgcggggaccggaauaagcugcgccaccucaucucggugaagcugggcaagaucccgacgguggagaacuccaucuuccacauggccgccuggagcggguccgccugucacgacggcaaggaguggaccuacaucggcgucgacgggcccgacaacaacgcccugcucaaggugaaguauggcgaggcguacaucgacaccuaccacagcuacgccaauaagauccugcggacccaggaguccgccugcaacugcaucgggggcaacugcuaccugaugaucacggauggcagcgccucggggguguccgagugccgcuuccucaagauccgggagggccgcaucaucaaggagaucuuccccaccgggcgggucaagcacaccgaggaguguacgugcggcuucgccagcaacaagaccaucgagugcgcgugccgcgacaaucgguacaccgccaagcgccccuucgugaagcugaacguggagaccgacaccgccgagauccggcugaugugcacggacaccuaucucgacaccccgcgccccaacgacggguccaucaccggccccugcgagagcgacggcgauaagggguccggcgggaucaagggcggguucguccaccagcggaugaaguccaagaucggccgcugguacagccggacgaugucgaagaccgagcgcaugggcauggggcuguacgugaaguacgauggcgaccccugggccgacuccgacgcccuggcguucagcggggugauggucuccaugaaggagccgggcugguacaguuucggguucgagaucaaggacaagaagugcgacgugcccugcaucggcaucgagauggugcaugacggcgggaaggagaccuggcacuccgccgccaccgccaucuacugccucaugggcagcgggcagcugcugugggacacggucaccggcguggacauggcccucuga

SEQ ID NO: 30518 - RNA, 1401 nt, Artificial Sequence
  derived and/or modified CDS sequence (AUadapt) from InfluenzaB__AKA54853__NA
augcugcccaguaccauccagacccucacgcuguuccugaccuccggcggggugcuccugagccuguacgucuccgccagccucuccuaucugcuguacagcgacauccuccugaaguucuccccgaccgagaucaccgcccccacgaugccccuggacugugcgaacgccagcaacgugcaggccgugaaccgcuccgccaccaagggcgucacccuccugcugcccgagccggaguggaccuacccccggcucaguugccccggguccacguuccagaaggcccugcugaucagcccccaccgcuucggcgagaccaaggggaauuccgcgccgcucaucauccgggagcccuucaucgccugcggccccaacgagugcaagcacuuugcccugacccacuacgccgcgcagcccggcggguacuacaacggcacccgcggggaucggaacaagcugcgccaccucaucagcgugaagcugggcaagaucccgacgguggagaacuccaucuuccauauggccgccuggagcggguccgccugccacgacggcaaggaguggaccuacaucggcgucgaugggcccgacaacaacgcccugcucaaggugaaguacggcgaggcguacaccgauaccuaccacucguacgccaacaagauccugcggacgcaggaguccgccuguaacugcaucgggggcaacugcuaucugaugaucaccgacggcagcgccagcgggguguccgagugccgcuuccucaagauccgggagggccgcaucaucaaggagaucuuucccaccgggcgggucaagcacaccgaggagugcacgugcggcuucgccagcaauaagaccaucgagugcgcgugccgcgacaaccgguacaccgccaagcgccccuuugugaagcugaacguggagaccgacacggccgagauccggcugaugugcaccgacaccuaccucgauaccccgcgccccaacgacggguccaucacgggccccugcgagagcgacggcgaugagggguccggcggggucaagggcggguucgugcaccagcggaugaaguccaagaucggccgcugguacagccggaccaugagcaagaccgagcgcaugggcauggggcuguaugugaaguacgacggcgaccccugggccgacuccgacgcccuggcguuuagcggggucaugguguccgugaaggagccgggcugguacagcuucggguucgagaucaaggauaagaagugcgacguccccugcaucggcaucgagauggugcacgacggcgggaaggagaccuggcauuccgccgccacggccaucuacugccucaugggcagcgggcagcugcugugggacaccgugaccggcgucgacauggcccucuga

SEQ ID NO: 30519 - RNA, 1401 nt, Artificial Sequence
  derived and/or modified CDS sequence (AUadapt) from InfluenzaB__AKA54855__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaacgccaguaacgugcaggccgugaaccgcuccgccaccaagggcgucacccuccugcugcccgagccggaguggaccuacccccggcucagcugccccggguccacguuucagaaggcccugcugaucagcccccaccgcuucggcgagaccaaggggaacuccgcgccgcucaucauccgggagcccuucaucgccugcggccccaaugagugcaagcacuucgcccugacccacuacgccgcgcagcccggcggguauuacaacggcacccgcggggaccggaacaagcugcgccaccucaucagcgugaagcugggcaagaucccgacgguggagaauuccaucuuccacauggccgccuggagcggguccgccugccacgauggcaaggaguggaccuacaucggcgucgacgggcccgacaacaacgcccugcucaaggugaaguacggcgaggcguauaccgacaccuaccacucguacgccaauaagauccugcggacgcaggaguccgccugcaacugcaucgggggcaacugcuaccugaugaucaccgauggcagcgccagcgggguguccgagugccgcuuccucaagauccgggagggccgcaucaucaaggagaucuuccccaccgggcgggucaagcauaccgaggagugcacgugcggcuucgccagcaacaagaccaucgagugcgcgugucgcgacaaccgguacaccgccaagcgccccuucgugaagcuggacguggagaccgauacggccgagauccggcugaugugcaccgacaccuaccucgacaccccgcgccccaacgacggguccaucacgggccccugugagagcgacggcgacaagggguccggcgggaucaagggcggguucguccaccagcggaugaaguccaagaucggccgcugguauucgcggaccaugagcaagaccgagcgcaugggcauggggcuguacgugaaguacgacggcgaccccugggccgauuccgacgcccuggcguucagcggggugauggucuccaugaaggagccgggcugguacagcuuuggguucgagaucaaggacaagaagugcgacgugcccugcaucggcaucgagauggugcacgauggcgggaaggagaccuggcacuccgccgccacggccaucuacugccucaugggcagcgggcagcugcugugggacaccgucaccggcguggacauggcccucuga

SEQ ID NO: 30520 - RNA, 1401 nt, Artificial Sequence
  derived and/or modified CDS sequence (AUadapt) from InfluenzaB__AKT07927__NA
augcccccgaguaccauccagacccugacccucuuccugaccuccggcggggugcugcucagccuguacgucuccgccagccuguccuaucuccuguacagcgacauccugcucaaguucucccccaccgagaucaccgcccccacgaugccccuggacugugcgaacgccagcaacgugcaggccgugaaccgcuccgccaccaagggcgucacccugcuccugccggagcccgaguggaccuacccccggcugaguugccccggguccacguuccagaaggcccuccugaucucgccgcaccgcuucggcgagacccgggggaauuccgcgccccugaucauccgcgagcccuucaucgccugcggccccaacgagugcaagcacuuugcccucacccacuacgccgcgcagccgggcggguacuacaacggcacccgcggggaucggaacaagcugcggcaccugaucagcgugaagcucggcaagauccccacgguggagaacuccaucuuccauauggccgccuggagcggguccgccugccacgacggcaaggaguggaccuacaucggcgucgaugggcccgacaacaacgcccugcugaaggugaaguacggcgaggcguacaccgauaccuaccacagcuacgccaacaagauccuccgcacgcaggaguccgccuguaacugcaucgggggcaacugcuaucugaugaucaccgacggcagcgccagcgggguguccgagugccgguuccugaagauccgcgagggccggaucaucaaggagaucuuucccaccgggcgcgucaagcacaccgaggagugcacgugcggcuucgccucgaauaagaccaucgagugcgcgugccgggacaacuccuacaccgccaagcgcccguuugugaagcucaacguggagaccgacacggccgagauccggcugaugugcaccgacaccuaccuggauacgccccgccccaacgacgggagcaucacgggccccugcgaguccgacggcgauaaggggagcggcgggaucaagggcggguucguccaccagcggauggaguccaagaucggccgcugguacagccggaccauguccaagaccgagcgcaugggcauggggcucuaugugaaguacgacggcgacccguggaccgacagcgaugcccuggccuucgggggcgugauggucuccaugaaggagcccgggugguacagcuucggcuucgagaucaaggauaagaagugcgacgugcccugcaucggcaucgagauggugcacgacgggggcaaggagacguggcauuccgcggccaccgccaucuacugccugauggggagcggccagcuccugugggacaccgucaccggcguggacauggcccuguga

SEQ ID NO: 30521 - RNA, 1401 nt, Artificial Sequence; identical to SEQ ID NO: 29232
  derived and/or modified CDS sequence (AUadapt) from InfluenzaB__AKT07931__NA

SEQ ID NO: 30522 - RNA, 1401 nt, Artificial Sequence
  derived and/or modified CDS sequence (AUadapt) from InfluenzaB__AKT07933__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccgcgaugccccuggacugcgccaacgccaguaacgugcaggccgugaaccgcuccgccacgaagggcgucaccuuccuccugcccgagccggaguggaccuacccccggcugagcugccccggguccaccuuucagaaggcgcuccugaucucgccccaccgcuucggcgagacgaaggggaacuccgccccgcugaucauccgggagcccuucaucgccugcggccccaaugagugcaagcacuucgcccucacccacuacgcggcccagcccggcggguacuauaacggcacccgcggggaccggaacaagcugcgccaccugaucagcgugaagcucggcaagaucccgaccguggagaacuccaucuuucacauggccgccuggagcggguccgccugccacgacggcaaggaguggacguacaucggcgucgaugggcccgacaacaacgcgcugcugaaggugaaguacggcgaggccuacaccgacaccuaucacagcuacgccaacaagauccuccggacccaggaguccgccugcaacuguaucgggggcaacugcuaccugaugaucacggacggcagcgccagcgggguguccgagugucgcuuccugaagauccgggagggccgcaucaucaaggagaucuuccccaccgggcgggucaagcacaccgaggagugcacgugcggcuucgcgaguaacaagaccaucgagugcgccugccgcgacaacuccuacaccgccaagcggcccuuugugaagcucaacguggagaccgacaccgccgagauccgccugaugugcacggacaccuaccuggacaccccgcggcccaaugacgggagcaucaccggccccugcgaguccgacggcgacaaggggagcggcgggaucaagggcggguuuguccaccagcgcauggaguccaagaucggccggugguacagccgcacgauguccaagaccgagcggaugggcauggggcucuacgugaaguacgacggcgaucccugggccgacagcgacgcgcuggccuucuccggggugauggucagcaugaaggagccgggcugguacuccuuuggguucgagaucaaggacaagaagugcgacgugcccugcaucggcaucgagauggugcacgauggcgggaaggagaccuggcacagcgccgccaccgccaucuacugccugaugggcuccgggcagcuccugugggacacggucaccggcguggacauggcgcuguga

SEQ ID NO: 30523 - RNA, 1401 nt, Artificial Sequence; identical to SEQ ID NO: 29232
  derived and/or modified CDS sequence (AUadapt) from InfluenzaB__AKT07935__NA

SEQ ID NO: 30524 - RNA, 1401 nt, Artificial Sequence; identical to SEQ ID NO: 29232
  derived and/or modified CDS sequence (AUadapt) from InfluenzaB__AKT07937__NA

SEQ ID NO: 30525 - RNA, 1401 nt, Artificial Sequence; identical to SEQ ID NO: 28640
  derived and/or modified CDS sequence (AUadapt) from InfluenzaB__AKT07939__NA

SEQ ID NO: 30526 - RNA, 1401 nt, Artificial Sequence; identical to SEQ ID NO: 29232
  derived and/or modified CDS sequence (AUadapt) from InfluenzaB__AKT07941__NA

SEQ ID NO: 30527 - RNA, 1401 nt, Artificial Sequence; identical to SEQ ID NO: 29232
  derived and/or modified CDS sequence (AUadapt) from InfluenzaB__AKT07945__NA

SEQ ID NO: 30528 - RNA, 1401 nt, Artificial Sequence
  derived and/or modified CDS sequence (AUadapt) from InfluenzaB__AKT07947__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccgcgaugccccuggacugcgccaacgccaguaacgugcaggccgugaaccgcuccgccacgaagggcgucacccuccugcugcccgagccggaguggaccuacccccggcucagcugccccggguccaccuuucagaaggcgcugcugaucagcccccaccgcuucggcgagacgaaggggaacuccgccccgcucaucauccgggagcccuucaucgccugcggccccaaugagugcaagcacuucgcccugacccacuacgcggcccagcccggcggguacuauaacggcacccgcggggaccggaacaagcugcgccaccucaucagcgugaagcugggcaagaucccgaccguggagaauuccaucuuccacauggccgccuggagcggguccgccugccacgacggcaaggaguggacguauaucggcgucgacgggcccgacaacaacgcgcugcucaaggugaaguacggcgaggccuacaccgauaccuaccacucguacgccaacaagauccugcggacccaggaguccgccuguaacugcaucgggggcaacugcuaccugaugaucacggacggcagugccagcgggguguccgagugccgcuuccucaagauccgggagggccgcaucaucaaggagaucuuccccaccgggcgggucaagcacaccgaggaguguacgugcggcuucgcgagcaacaagaccaucgagugcgccugccgcgauaacuccuacaccgccaagcggcccuucgugaagcugaacguggagaccgacaccgccgagauccgccugaugugcacggauaccuaccucgacaccccgcggcccaacgacgggagcaucaccggccccugugaguccgacggcgacaaggggagcggcgggaucaagggcggguucguccaccagcgcauggaguccaagaucggccggugguacagucgcacgauguccaagaccgagcggaugggcauggggcuguacgugaaguacgacggcgaccccugggccgacagcgaugcgcuggccuucuccggggugauggucagcaugaaggagccgggcugguacuccuucggguucgagaucaaggauaagaagugcgacgugcccugcaucggcguggacaugguccacgacuguggcaaggagaccuggcacagcgccgccaccgccaucuacugccucaugggguccggccagcugcugugggacacggugaccgggguggacauggcgcucuga

SEQ ID NO: 30529 - RNA, 1401 nt, Artificial Sequence; identical to SEQ ID NO: 28646
  derived and/or modified CDS sequence (AUadapt) from InfluenzaB__AKU40585__NA

SEQ ID NO: 30530 - RNA, 1401 nt, Artificial Sequence; identical to SEQ ID NO: 28646
  derived and/or modified CDS sequence (AUadapt) from InfluenzaB__AKU40596__NA

SEQ ID NO: 30531 - RNA, 1401 nt, Artificial Sequence
  derived and/or modified CDS sequence (AUadapt) from InfluenzaB__AKU40607__NA
augcugcccaguaccauccagacccucacgcuguuccugaccuccggcggggugcuccugagccuguacgucuccgccagccucuccuaucugcuguacagcgacauccuccugaaguucucccgcaccgaggugaccgccccgaucacgccccuggauugcgcgaacgccagcaacgcccaggccgugaaccgguccgccaccaagggcgucacgccccuccugcccgagccggaguggaccuauccccgccugagcugccccggguccaccuuccagaaggcgcuccugaucucgccccaucgguucggcgagaccaaggggaacuccgccccgcugaucauccgcgagcccuucaucgccugcggccccaaggagugcaagcauuucgcccucacccacuacgcggcccagcccggcggguacuauaacggcacccgggaggaccgcaacaagcugcggcaccugaucagugugaagcucgggaagaucccgacgguggagaacuccaucuuccacauggccgccuggagcggcuccgccugccaugacgggcgcgaguggaccuacaucggcgucgacggccccgacaguaacgcgcugcugaagaucaaguacggggaggccuacaccgacaccuaccauuccuacgccaagaacauccuccggacgcaggagagcgccugcaauugcaucggcggggacugcuaccugaugaucaccgauggccccgccagcggcaucuccgagugccgcuuccugaagauccgggaggggcgcaucaucaaggagaucuuccccaccggccgggugaagcacaccgaggaguguacgugcggguucgcgucgaacaagaccaucgagugugccugccgcgacaacuccuacaccgccaagcggccguucgugaagcucaaugucgagaccgacacggccgagauccgccugaugugcaccaagaccuaccuggacacgccccggcccaaugacggcagcaucaccgggcccugcgaguccgacggcgaugagggcagcgggggcaucaagggcggguucgugcaccagcgcauggccuccaagaucgggcggugguacagccgcaccauguccaagaccaagcggaugggcaugggccucuaugugaaguacgacggggacccguggaccgacagugaggcgcuggcccuguccggcgucauggugagcauggaggagcccgggugguacuccuucggcuucgagaucaaggacaagaagugugacgugcccugcaucgggaucgagaugguccacgacggcggcaagacgaccuggcauagcgccgccaccgccaucuacugccucaugggguccggccagcugcugugggacaccgugacgggggugaacaugacccucuga

SEQ ID NO: 30532 - RNA, 1401 nt, Artificial Sequence
  derived and/or modified CDS sequence (AUadapt) from InfluenzaB__AKU40618__NA
augcugcccaguaccauccagacccucacgcuguuccugaccuccggcggggugcuccugagccuguacgucuccgccagccucuccuaccugcuguauagcgacauccuccugaaguucucccgcaccgaggugaccgccccgaucaugccccuggacugcgcgaaugccagcaacgugcaggccgucaaccgguccgccacgaagggcgugacgccccuccugcccgagccggaguggaccuacccccgccugagcugucccggguccaccuuccagaaggcccuccugaucucgccccaccgguucggcgagaccaaggggaacuccgcgccgcugaucauccgcgagcccuuuaucgccugcggccccaaggagugcaagcacuucgcccucacccacuaugccgcgcagcccggcggguacuacaacggcacccgggaggaccgcaacaagcugcggcaucugaucagcgugaagcucgggaagaucccgaccgucgagaacuccaucuuccacauggccgccuggagcggcuccgccugucacgacgggcgcgaguggacguacaucggcguggacggccccgacaguaacgcccugcugaagaucaaguacggggaggcguacaccgacaccuaccauuccuacgccaagaacauccuccggacccaggagagcgccugcaacuguaucggcggggacugcuaccugaugaucacggacggccccgccagcggcaucuccgagugucgcuuccugaagauccgggaggggcgcaucaucaaggagaucuuccccaccggccgggugaagcacaccgaggagugcacgugcggguuugccucgaacaagaccaucgagugcgcgugccgcgacaauuccuacaccgccaagcggccguucgucaagcucaacguggagaccgacaccgccgagauccgccugaugugcacgaagaccuaucuggacacgccccggcccaacgacggcagcaucaccgggcccugcgaguccgauggcgacgagggcagcgggggcaucaagggcggguucgugcaccagcgcauggccuccaagaucgggcggugguacagucgcaccauguccaagaccaagcggaugggcaugggccucuacgucaaguacgacggggacccguggaccgacagugaggcccuggcgcuguccggcgugauggugagcauggaggagcccgggugguacuccuucggcuucgagaucaaggacaauaagugcgacguccccugcaucgggaucgagauggugcacgacggcggcaagaccacguggcauagcgccgccaccgccaucuacugccucaugggguccggccagcugcugugggacaccgugaccggggucaacaugacgcucuga

SEQ ID NO: 30533 - RNA, 1401 nt, Artificial Sequence
  derived and/or modified CDS sequence (AUadapt) from InfluenzaB__AKU40640__NA
augcugcccaguaccauccagacccucacgcuguuccugaccuccggcggggugcuccugagccuguacgucuccgccagccucuccuaccugcuguauucggacauccuccugaaguucucccgcaccgagaucgccgcgccgaucaugccccuggacugcgccaacgccaguaacgugcaggccgugaaccgguccgccaccaagggcgucgcgcuccugcugcccgagcccgaguggacguacccgcgccucagcugccccggguccaccuuccagaaggcccugcugaucaguccccaccgguucggcgagaccaaggggaacuccgcgccccucaucauccgcgagccguucaucgccugcggccccaaggaguguaagcacuucgcccugacccacuacgccgcccagcccggcggguacuacaauggcacgcgggaggaccgcaacaagcugcggcaccucaucucggugaagcuggggaagauccccaccguggagaacuccaucuuccauauggccgccuggagcggcuccgcgugccacgacgggcgcgaguggaccuacaucggcgucgauggcccggacaacaacgcccugcucaagaucaaguacggggaggccuacaccgacacguaucacagcuacgccaagaacauccugcggacccaggaguccgccugcaacuguaucggcggggacugcuaccugaugaucaccgacggccccgcgagcggcaucagugagugccgcuuccucaagauccgggaggggcgcaucaucaaggagaucuuccccaccggccgggugaagcacacggaggagugcacgugcggguuugccuccaacaagaccaucgagugcgccugccgcgacaacagcuauaccgccaagcggcccuucgugaagcugaacgucgagaccgacaccgccgagauccgccugaugugcaccgagaccuaccucgauacgccgcggcccaacgacggcuccaucaccgggcccugcgagagcaacggcgacaagggcuccgggggcaucaagggcggguuugugcaccagcgcauggcgagcaagaucgggcggugguacucccgcaccaugucgaagaccaagcggaugggcaugggccuguacgugaaguacgauggggaccccuggacggacuccgaggcccuggcccucagcggcgucaugguguccauggaggagccggggugguacagcuuuggcuucgagaucaaggacaagaagugcgacgugcccugcaucgggaucgagaugguccacgauggcggcaagaccaccuggcacuccgccgccaccgcgaucuacugccugauggggagcggccagcugcucugggacacggugaccggggugaacaugacccuguga

SEQ ID NO: 30534 - RNA, 1401 nt, Artificial Sequence; identical to SEQ ID NO: 28646
  derived and/or modified CDS sequence (AUadapt) from InfluenzaB__AKU40662__NA

SEQ ID NO: 30535 - RNA, 1401 nt, Artificial Sequence
  derived and/or modified CDS sequence (AUadapt) from InfluenzaB__AKU40673__NA
augcugcccaguaccauccagacccucacgcuguuccugaccuccggcggggugcuccugagccuguacgucuccgccagccucuccuaccugcuguauagcgacauccuccugaaguucucccgcaccgaggugaccgccccgaucaugccccuggacugcgcgaaugccagcaacgugcaggccgucaaccgguccgccacgaagggcgugacgccccuccugcccgagucggaguggaccuacccgcgccuguccugucccgggagcaccuuccagaaggcccuccugaucagcccccaccgguucggcgagaccaaggggaacuccgcgccccugaucauccgcgagccguuuaucgccugcggccccaaggagugcaagcacuucgcccucacccacuaugccgcgcagcccggcggguacuacaacggcacccgggaggaccgcaacaagcugcggcaucugaucuccgugaagcucgggaagauccccaccgucgagaacagcaucuuccacauggccgccugguccggcagcgccugccaugacgggcgcgaguggacguacaucggcguggacggcccggacuccaacgcccugcugaagaucaaguauggggaggcguacaccgacaccuaccacucguaugccaagaacauccuccggacccaggagagcgccugcaacugcaucggcggggacuguuaccugaugaucacggacggccccgccuccggcaucagcgagugccgcuuccugaagauccgggaggggcgcaucaucaaggagaucuuucccaccggccgggugaagcacaccgaggagugcacgugcggguucgccuccaacaagaccaucgagugugcgugccgcgacaacagcuacaccgccaagcggcccuucgucaagcucaauguggagaccgacaccgccgagauccgccugaugugcacgaagaccuaccuggacaccccgcggcccaacgauggcuccaucaccgggcccugcgagagcgacggcgacgagggcuccgggggcaucaagggcggguucgugcaucagcgcauggccucgaagaucgggcggugguacucccgcacgaugagcaagaccaagcggaugggcaugggccucuacgucaaguacgacggggaucccuggaccgacuccgaggcccuggcgcugagcggcgugaugguguccauggaggagccggggugguacagcuucggcuuugagaucaaggacaagaagugcgacguccccugcaucgggaucgagauggugcacgauggcggcaagaccacguggcacuccgccgccaccgccaucuacugccucauggggagcggccagcugcugugggacaccgugaccggggucaacaugacgcucuga

SEQ ID NO: 30536 - RNA, 1401 nt, Artificial Sequence; identical to SEQ ID NO: 28646
  derived and/or modified CDS sequence (AUadapt) from InfluenzaB__AKU40684__NA

SEQ ID NO: 30537 - RNA, 1401 nt, Artificial Sequence; identical to SEQ ID NO: 28646
  derived and/or modified CDS sequence (AUadapt) from InfluenzaB__AKU40695__NA

SEQ ID NO: 30538 - RNA, 1401 nt, Artificial Sequence; identical to SEQ ID NO: 28646
  derived and/or modified CDS sequence (AUadapt) from InfluenzaB__AKU40706__NA

SEQ ID NO: 30539 - RNA, 1401 nt, Artificial Sequence; identical to SEQ ID NO: 28646
  derived and/or modified CDS sequence (AUadapt) from InfluenzaB__AKU40717__NA

SEQ ID NO: 30540 - RNA, 1401 nt, Artificial Sequence; identical to SEQ ID NO: 28681
  derived and/or modified CDS sequence (AUadapt) from InfluenzaB__AKU40728__NA

SEQ ID NO: 30541 - RNA, 1401 nt, Artificial Sequence
  derived and/or modified CDS sequence (AUadapt) from InfluenzaB__AKU40739__NA
augcugcccaguaccauccagacccucacgcuguuccugaccuccggcggggugcuccugagccuguacgucuccgccagccucuccuaccugcuguauagcgacauccuccugaaguucucccgcaccgaggugaccgccccgaucaugccccuggacugcgcgaaugccucgaacgugcaggccgucaaccgguccgccacgaagggcgugacgccccuccugcccgagccggaguggaccuacccccgccugagcugucccggguccaccuuccagaaggcccuccugaucagcccccaccgguucggcgagaccaaggggaacuccgcgccgcugaucauccgcgagcccuucaucgccuguggccccaaggagugcaagcacuucgcccucacccacuacgccgcgcagcccggcggguauuacaacggcacccgggaggaccgcaacaagcugcggcaccugaucagugugaagcucgggaagaucccgaccgucgagaacuccaucuuccacauggccgccuggagcggcuccgccugccaugacgggcgcgaguggacguacaucggcguggacggccccgacucgaacgcccugcugaagaucaaguauggggagaccuacaccgacaccuaccacuccuacgcgaagaauauccuccggacgcaggagagcgccugcaacugcaucggcggggacuguuaccugaugaucaccgacggccccgccagcggcaucuccgagugccgcuuccugaagauccgggaggggcgcaucaucaaggagaucuuucccaccggccgggugaagcacaccgaggagugcacgugcggguucgccagcaacaagaccaucgagugugccugccgcgacaacuccuacaccgcgaagcggccguucgucaagcucaauguggagaccgacacggccgagauccgccugaugugcaccaagaccuaccuggacacgccccggcccaacgauggcagcaucaccgggcccugcgaguccgacggcgacgagggcucggggggcaucaagggcggguuugugcaccagcgcauggccuccaagaucgggcggugguacagccgcaccauguccaagaccaagcggaugggcaugggccucuacgucaaguacgacggggauccguggaccgacagcgaggcccuggcccuguccggcgugauggugagcauggaggagcccgggugguacuccuucggcuuugagaucaaggacaagaagugcgacguccccugcaucgggaucgagauggugcacgauggcggcaagacgaccuggcacagcgcggccaccgccaucuacugccucaugggguccggccagcugcugugggacaccgugacgggggucaacaugacccucuga

SEQ ID NO: 30542 - RNA, 1401 nt, Artificial Sequence
  derived and/or modified CDS sequence (AUadapt) from InfluenzaB__AKU40750__NA
augcugcccaguaccauccagacccucacgcuguuccugaccuccggcggggugcuccugagccuguacgucuccgccagccucuccuaccugcuguauagcgacauccuccugaaguucucccgcaccgaggugaccgccccgaucaugccccuggacugcgcgaaugccagcaacgugcaggccgucaaccgguccgccacgaagggcgugaucccccuccugcccgagccggaguggaccuacccccgccugagcugucccggguccaccuuccagaaggcccuccugaucucgccccaccgguucggcgagaccaaggggaacuccgcgccgcugaucauccgcgagcccuucaucgccuguggccccaaggagugcaagcacuucgcccucacgcacuacgccgcgcagcccggcggguauuacaacggcacccgggaggaccgcaacaagcugcggcaccugaucagugugaagcucgggaagaucccgaccgucgagaacuccaucuuccacauggccgccuggagcggcuccgccugccaugacgggcgcgaguggaccuacaucggcguggacggccccgacagcaacgcccugcugaagaucaaguauggggaggcguacacggacaccuaccacuccuacgccaagaauauccuccggacccaggagagcgccugcaacugcaucggcggggacuguuaccugaugaucaccgacggccccgccagcggcaucuccgagugccgcuuccugaagauccgggaggggcgcaucaucaaggagaucuuucccacgggccgggugaagcacaccgaggagugcacgugcggguucgccucgaacaagaccaucgagugugcgugccgcgacaacuccuacaccgccaagcggccguucgucaagcucaauguggagaccgacaccgccgagauccgccugaugugcaccaagacguaccuggacacgccccggcccaacgauggcagcaucaccgggcccugcgaguccgacggcgacgagggcagcgggggcaucaagggcggguuugugcaccagcgcauggccuccaagaucgggcggugguacagccgcaccauguccaagaccaagcggaugggcaugggccucuacgucaaguacgacggggauccguggaccgacagcgaggcccuggcgcuguccggcgugauggugagcauggaggagcccgggugguacuccuucggcuuugagaucaaggacaagaagugcgacguccccugcaucgggaucgagauggugcacgauggcggcaagaccaccuggcacagcgccgccacggccaucuacugccucaugggguccggccagcugcugugggacaccgugaccggggucaacaugacccucuga

SEQ ID NO: 30543 - RNA, 1401 nt, Artificial Sequence; identical to SEQ ID NO: 28646
  derived and/or modified CDS sequence (AUadapt) from InfluenzaB__AKU40761__NA

SEQ ID NO: 30544 - RNA, 1401 nt, Artificial Sequence; identical to SEQ ID NO: 28646
  derived and/or modified CDS sequence (AUadapt) from InfluenzaB__AKU40772__NA

SEQ ID NO: 30545 - RNA, 1401 nt, Artificial Sequence; identical to SEQ ID NO: 28646
  derived and/or modified CDS sequence (AUadapt) from InfluenzaB__AKU40783__NA

SEQ ID NO: 30546 - RNA, 1401 nt, Artificial Sequence
  derived and/or modified CDS sequence (AUadapt) from InfluenzaB__AKU40794__NA
augcugcccaguaccauccagacccucacgcuguuccugaccuccggcggggugcuccugagccuguacgucuccgccagccucuccuaccugcuguauagcgacauccuccugaaguucucccgcaccgaggugaccgccccgaucaugccccuggacugcgcgaauacgucgaacgugcaggccgucaaccgguccgccaccaagggcgugacgccccuccugcccgagccggaguggaccuacccccgccugagcugucccggguccaccuuccagaaggcccuccugaucagcccccaccgguucggcgagaccaaggggaaguccgccccgcugaucauccgcgagcccuucaucgcguguggccccaaggagugcaagcacuucgcccucacccacuacgccgcccagcccggcggguacuauaacggcacccgggaggaccgcaacaagcugcggcaccugaucagcgugaagcucgggaagaucccgacggucgagaauuccaucuuccacauggcggccuggagcggcuccgccugccacgaugggcgcgaguggaccuacaucggcguggacggccccgacucgaacgcccugcugaagaucaaguauggggaggccuacaccgacaccuaccacuccuacgcgaagaauauccuccggacgcaggagagcgccugcaacugcaucggcggggacugcuaucugaugaucaccgacggccccgccagcggcaucuccgagugccgcuuccugaagauccgggaggggcgcaucaucaaggagaucuuccccaccggccgggugaagcauaccgaggagugcacgugcggguucgccagcaacaagaccaucgagugugccugccgcgacaacuccuacaccgcgaagcggccguucgucaagcucaauguggagaccgacacggccgagauccgccugaugugcaccaagaccuaccuggacacgccccggcccaacgauggcagcaucaccgggcccugcgaguccgacggcgacgagggcucggggggcaucaagggcggguucgugcaucagcgcauggccuccaagaucgggcggugguacagccgcaccauguccaagaccaagcggaugggcaugggccucuacgucaaguacgacggggauccguggaccgacagcgaggcccuggcccuguccggcgugauggugagcauggaggagcccgggugguacuccuucggcuuugagaucaaggacaagaagugcgacguccccugcaucgggaucgagauggugcacgauggcggcaagacgaccuggcacagcgcggccaccgccaucuacugccucaugggguccggccagcugcugugggacaccgugacgggggucaacaugacccucuga

SEQ ID NO: 30547 - RNA, 1401 nt, Artificial Sequence; identical to SEQ ID NO: 28646
  derived and/or modified CDS sequence (AUadapt) from InfluenzaB__AKU40805__NA

SEQ ID NO: 30548 - RNA, 1401 nt, Artificial Sequence; identical to SEQ ID NO: 28646
  derived and/or modified CDS sequence (AUadapt) from InfluenzaB__AKU40816__NA

SEQ ID NO: 30549 - RNA, 1401 nt, Artificial Sequence; identical to SEQ ID NO: 28646
  derived and/or modified CDS sequence (AUadapt) from InfluenzaB__AKU40827__NA

SEQ ID NO: 30550 - RNA, 1401 nt, Artificial Sequence; identical to SEQ ID NO: 28646
  derived and/or modified CDS sequence (AUadapt) from InfluenzaB__AKU40838__NA

SEQ ID NO: 30551 - RNA, 1401 nt, Artificial Sequence; identical to SEQ ID NO: 28646
  derived and/or modified CDS sequence (AUadapt) from InfluenzaB__AKU40849__NA

SEQ ID NO: 30552 - RNA, 1401 nt, Artificial Sequence; identical to SEQ ID NO: 28646
  derived and/or modified CDS sequence (AUadapt) from InfluenzaB__AKU40860__NA

SEQ ID NO: 30553 - RNA, 1401 nt, Artificial Sequence
  derived and/or modified CDS sequence (AUadapt) from InfluenzaB__AKU40871__NA
augcugcccaguaccauccagacccucacgcuguuccugaccuccggcggggugcuccugagccuguacgucuccgccagccucuccuaucugcuguacagcgacauccuccugaaguucucccgcaccgaggugaccgccccgaucaugccccuggacugugcgaacgccagcaacgugcaggccgucaaccgguccgccacgaagggcguggcgccccuccugcccgagccggaguggaccuacccccgccugaguugccccggguccaccuuccagaaggcccuccugaucucgccccaccgguucggcgagaccaaggggaauuccgccccgcugaucauccgcgagcccuucaucgccugcggccccaaggagugcaagcacuucgcccucacgcauuacgcggcccagcccggcggguacuacaacggcacccgggaggaccgcaauaagcugcggcaccugaucagcgugaagcucgggaagaucccgaccgucgagaacuccaucuuccacauggccgccuggaguggcuccgccugccacgacgggcgcgaguggaccuacaucggcguggacggccccgauagcaacgcgcugcugaagaucaaguacggggaggccuacacggacaccuaucacuccuacgccaagaacauccuccggacccaggagagcgccugcaauugcaucggcggggacugcuaccugaugaucaccgacggccccgccaguggcaucuccgagugccgcuuccugaagauccgggaggggcgcaucaucaaggagaucuuccccacgggccgggugaagcacaccgaggagugcacguguggguucgcgucgaacaagaccaucgagugcgccugccgcgauaacuccuacaccgccaagcggccguucgucaagcucaacguggagaccgacaccgccgagauccgccugauguguaccaagacguaccuggacacgccccggcccaacgacggcagcaucaccgggcccugugaguccgacggcgacgagggcagcgggggcaucaagggcggguucgugcaccagcgcauggccuccaagaucgggcggugguauagccgcaccauguccaagaccaagcggaugggcaugggccucuacgucaaguacgacggggacccguggaccgauagcgaggcgcugacccuguccggcgugauggugagcauggaggagcccgggugguacuccuucggcuucgagaucaaggauaagaagugcgacguccccugcaucgggaucgagauggugcacgacggcggcaagaccacguggcauagcgccgccaccgccaucuacugccucaugggguccggccagcugcugugggacaccgugaccggggucaacaugacgcucuga

SEQ ID NO: 30554 - RNA, 1401 nt, Artificial Sequence; identical to SEQ ID NO: 28646
  derived and/or modified CDS sequence (AUadapt) from InfluenzaB__AKU40882__NA

SEQ ID NO: 30555 - RNA, 1401 nt, Artificial Sequence
  derived and/or modified CDS sequence (AUadapt) from InfluenzaB__AKU40893__NA
augcugcccaguaccauccagacccucacgcuguuccugaccuccggcggggugcuccugagccuguacgucuccgccagccucuccuaccugcuguauagcgacauccuccugaaguucuccccgaccgagaucaccgcccccacgaugccccuggacugcgcgaaugccucgaacgugcaggccgugaaccgcuccgccaccaagggcgucacccuccugcugcccgagccggaguggaccuacccccggcucagcugccccggguccacguuucagaaggcccugcugaucagcccccaccgcuucggcgagaccaaggggaacuccgcgccgcucaucauccgggagcccuucaucgccuguggccccaacgagugcaagcacuucgcccugacccacuacgccgcgcagcccggcggguauuacaacggcacccgcggggaccggaacaagcugcgccaccucaucagugugaagcugggcaagaucccgacgguggagaacuccaucuuccacauggccgccuggagcggguccgccugccacgauggcaaggaguggaccuacaucggcgucgacgggcccgacaacaacgcccugcucaaggugaaguauggcgaggcguacaccgacaccuaccacucguacgccaauaagauccugcggacgcaggaguccgccugcaacugcaucgggggcaacugcuaucugaugaucaccgacggcagcgccagcgggguguccgagugccgcuuccucaagauccgggagggccgcaucaucaaggagaucuuccccaccgggcgggucaagcauaccgaggagugcacgugcggcuucgccagcaacaagaccaucgagugugcgugccgcgacaaccgguacaccgccaagcgccccuucgugaagcugaacguggagaccgauacggccgagauccggcugaugugcaccgacaccuaccucgacaccccgcgccccaacgauggguccaucacgggccccugcgagagcgacggcgacaagggguccggcgggaucaagggcggguucguccaccagcggaugaaguccaagaucggccgcugguauucgcggaccaugagcaagaccgagcgcaugggcauggggcuguacgugaaguacgacggcgaucccugggccgacuccggggcccuggcguucagcggcgugauggucuccaugaaggagccggggugguacagcuucggcuuugagaucaaggacaagaagugcgacgugcccugcaucggcaucgagauggugcacgaugggggcaaggagaccuggcacuccgccgccacggccaucuacugccucauggggagcggccagcugcugugggacaccgucaccggcguggacauggcccucuga

SEQ ID NO: 30556 - RNA, 1401 nt, Artificial Sequence; identical to SEQ ID NO: 28646
  derived and/or modified CDS sequence (AUadapt) from InfluenzaB__AKU40904__NA

SEQ ID NO: 30557 - RNA, 1401 nt, Artificial Sequence
  derived and/or modified CDS sequence (AUadapt) from InfluenzaB__AKU40915__NA
augcugcccaguaccauccagacccucacgcuguuccugaccuccggcggggugcuccugagccuguacgucuccgccagccucuccuaucugcuguacagcgacauccuccugaaguucucccgcaccgaggugaccgccccgaucaugccccuggacugugcgaacgccagcaacgugcaggccgucaaccgguccgccacgaagggcgugacgccccuccugcccgagccggaguggaccuacccccgccugaguugccccggguccaccuuccagaaggcccuccugaucucgccccaccgguuuggcgagaccaaggggaacuccgcgccgcugaucauccgcgagcccuucaucgccugcggccccaaggagugcaagcacuuugcccucacccacuacgccgcgcagcccggcggguacuacaacggcacccgggaggaucgcaacaagcugcggcaccugaucagcgugaagcucgggaagaucccgaccgucgagaacuccaucuuucacauggccgccuggagcggcuccgccugccacgacgggcgcgaguggacguauaucggcguggacggccccgacagcaacgcccugcugaagaucaaguacggggaggcguauaccgacaccuaccacuccuacgccaagaauauccuccggacccaggagagcgccugcaacugcaucggcggggacuguuaccugaugaucacggacggccccgccagcggcaucuccgagugccgcuuccugaagauccgggaggggcgcaucaucaaggagaucuuucccaccggccgggugaagcacaccgaggagugcacgugcggguucgccaguaacaagaccaucgagugcgcgugccgcgacaacuccuauaccgccaagcggccguucgucaagcucaacguggagaccgacaccgccgagauccgccugaugugcacgaagaccuaccuggauacgccccggcccaacgacggcagcaucaccgggcccugcgaguccgauggcgacgagggcagcgggggcaucaagggcggguucgugcaccagcgcauggccuccaagaucgggcggugguacagucgcaccauguccaagaccaagcggaugggcaugggccucuacgucaaguacgacggggacccguggaccgacagugaggcccuggcgcuguccggcgugauggugcccauggaggagcccgggugguacagcuucggcuucgagaucaaggauaagaagugcgacguccccugcaucgggaucgagauggugcacgacggcggcaagaccacguggcauuccgccgccaccgccaucuacugccucauggggagcggccagcugcugugggacaccgugaccggggucaacaugacgcucuga

SEQ ID NO: 30558 - RNA, 1401 nt, Artificial Sequence; identical to SEQ ID NO: 28646
  derived and/or modified CDS sequence (AUadapt) from InfluenzaB__AKU40926__NA

SEQ ID NO: 30559 - RNA, 1401 nt, Artificial Sequence; identical to SEQ ID NO: 30541
  derived and/or modified CDS sequence (AUadapt) from InfluenzaB__AKU40937__NA

SEQ ID NO: 30560 - RNA, 1401 nt, Artificial Sequence; identical to SEQ ID NO: 28646
  derived and/or modified CDS sequence (AUadapt) from InfluenzaB__AKU40948__NA

SEQ ID NO: 30561 - RNA, 1401 nt, Artificial Sequence; identical to SEQ ID NO: 28646
  derived and/or modified CDS sequence (AUadapt) from InfluenzaB__AKU40959__NA

SEQ ID NO: 30562 - RNA, 1401 nt, Artificial Sequence; identical to SEQ ID NO: 28646
  derived and/or modified CDS sequence (AUadapt) from InfluenzaB__AKU40970__NA

SEQ ID NO: 30563 - RNA, 1401 nt, Artificial Sequence; identical to SEQ ID NO: 28646
  derived and/or modified CDS sequence (AUadapt) from InfluenzaB__AKU40981__NA

SEQ ID NO: 30564 - RNA, 1401 nt, Artificial Sequence; identical to SEQ ID NO: 28646
  derived and/or modified CDS sequence (AUadapt) from InfluenzaB__AKU40991__NA

SEQ ID NO: 30565 - RNA, 1401 nt, Artificial Sequence; identical to SEQ ID NO: 28646
  derived and/or modified CDS sequence (AUadapt) from InfluenzaB__AKU41002__NA

SEQ ID NO: 30566 - RNA, 1401 nt, Artificial Sequence; identical to SEQ ID NO: 28646
  derived and/or modified CDS sequence (AUadapt) from InfluenzaB__AKU41013__NA

SEQ ID NO: 30567 - RNA, 1401 nt, Artificial Sequence; identical to SEQ ID NO: 28646
  derived and/or modified CDS sequence (AUadapt) from InfluenzaB__AKU41024__NA

SEQ ID NO: 30568 - DNA, 42 bp, Artificial Sequence
  5'-UTR of human ribosomal protein Large 32 lacking the 5' terminal oligopyrimidine tract (RPL32, 32L4)
ggcgctgcctacggaggtggcagccatctccttctcggcatc

SEQ ID NO: 30569 - RNA, 42 nt, Artificial Sequence
  5'-UTR of human ribosomal protein Large 32 lacking the 5' terminal oligopyrimidine tract (RPL32, 32L4) mRNA
ggcgcugccuacggagguggcagccaucuccuucucggcauc

SEQ ID NO: 30570 - DNA, 110 bp, Artificial Sequence
  3'-UTR of Homo sapiens hemoglobin, alpha 1 (HBA1)
gctggagcctcggtggccatgcttcttgccccttgggcctccccccagcccctcctccccttcctgcacccgtacccccgtggtctttgaataaagtctgagtgggcggc

SEQ ID NO: 30571 - RNA, 110 nt, Artificial Sequence
  3'-UTR of Homo sapiens hemoglobin, alpha 1 (HBA1) mRNA
gcuggagccucgguggccaugcuucuugccccuugggccuccccccagccccuccuccccuuccugcacccguacccccguggucuuugaauaaagucugagugggcggc

SEQ ID NO: 30572 - DNA, 108 bp, Artificial Sequence
  3'-UTR of Homo sapiens hemoglobin, alpha 2 (HBA2)
gctggagcctcggtagccgttcctcctgcccgctgggcctcccaacgggccctcctcccctccttgcaccggcccttcctggtctttgaataaagtctgagtgggcag

SEQ ID NO: 30573 - RNA, 108 nt, Artificial Sequence
  3'-UTR of Homo sapiens hemoglobin, alpha 2 (HBA2) mRNA
gcuggagccucgguagccguuccuccugcccgcugggccucccaacgggcccuccuccccuccuugcaccggcccuuccuggucuuugaauaaagucugagugggcag

SEQ ID NO: 30574 - DNA, 132 bp, Artificial Sequence
  3'-UTR of Homo sapiens hemoglobin, beta (HBB)
gctcgctttcttgctgtccaatttctattaaaggttcctttgttccctaagtccaactactaaactgggggatattatgaagggccttgagcatctggattctgcctaataaaaaacatttattttcattgc

SEQ ID NO: 30575 - RNA, 132 nt, Artificial Sequence
  3'-UTR of Homo sapiens hemoglobin, beta (HBB) mRNA
gcucgcuuucuugcuguccaauuucuauuaaagguuccuuuguucccuaaguccaacuacuaaacugggggauauuaugaagggccuugagcaucuggauucugccuaauaaaaaacauuuauuuucauugc

SEQ ID NO: 30576 - DNA, 44 bp, Artificial Sequence
  Center, alpha-complex-binding portion of the 3'-UTR of an alpha-globin gene (muag)
gcccgatgggcctcccaacgggccctcctcccctccttgcaccg

SEQ ID NO: 30577 - RNA, 44 nt, Artificial Sequence
  Center, alpha-complex-binding portion of the 3'-UTR of an alpha-globin gene (muag) mRNA
gcccgaugggccucccaacgggcccuccuccccuccuugcaccg

SEQ ID NO: 30578 - DNA, 186 bp, Artificial Sequence
  3'-UTR of human albumin
catcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatct

SEQ ID NO: 30579 - RNA, 186 nt, Artificial Sequence
  3'-UTR of human albumin mRNA
caucacauuuaaaagcaucucagccuaccaugagaauaagagaaagaaaaugaagaucaaaagcuuauucaucuguuuuucuuuuucguugguguaaagccaacacccugucuaaaaaacauaaauuucuuuaaucauuuugccucuuuucucugugcuucaauuaauaaaaaauggaaagaaucu

SEQ ID NO: 30580 - DNA, 186 bp, Artificial Sequence
  3'-UTR albumin7
catcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 30581 - RNA, 186 nt, Artificial Sequence
  3'-UTR albumin7 mRNA
caucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccu

SEQ ID NO: 30582 - DNA, 187 bp, Artificial Sequence
  3'-UTR ALB7
gcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 30583 - RNA, 187 nt, Artificial Sequence
  3'-UTR ALB7 mRNA
gcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccu

SEQ ID NO: 30584 - DNA, 24 bp, Artificial Sequence
  histone stem-loop sequence (histoneSL, hSL)
caaaggctcttttcagagccacca

SEQ ID NO: 30585 - RNA, 24 nt, Artificial Sequence
  histone stem-loop sequence (histoneSL, hSL) mRNA
caaaggcucuuuucagagccacca

SEQ ID NO: 30586 - DNA, 13 bp, Artificial Sequence
  Kozak
gccgccaccatgg

SEQ ID NO: 30587 - RNA, 13 nt, Artificial Sequence
  Kozak mRNA
gccgccaccaugg

SEQ ID NO: 30588 - RNA, 2311 nt, Artificial Sequence
  mRNA product comprising derived and/or modified sequence from YFV(17D)__prME R7250
gggagaaagcuuaccaugcgcggccucuccucccgcaagcgccgcucccacgacguccucaccguccaguuccucauccucggcaugcuccucaugaccggcggcgucacccucguccgcaagaaccgcuggcuccuccucaacgucaccuccgaggaccucggcaagaccuucuccgucggcaccggcaacugcaccaccaacauccucgaggccaaguacuggugccccgacuccauggaguacaacugccccaaccucuccccccgcgaggagcccgacgacaucgacugcuggugcuacggcgucgagaacguccgcgucgccuacggcaagugcgacuccgccggccgcucccgccgcucccgccgcgccaucgaccuccccacccacgagaaccacggccucaagacccgccaggagaaguggaugaccggccgcaugggcgagcgccagcuccagaagaucgagcgcugguucguccgcaaccccuucuucgccgucaccgcccucaccaucgccuaccucgucggcuccaacaugacccagcgcgucgucaucgcccuccucguccucgccgucggccccgccuacuccgcccacugcaucggcaucaccgaccgcgacuucaucgagggcguccacggcggcaccugggucuccgccacccucgagcaggacaagugcgucaccgucauggcccccgacaagcccucccucgacaucucccucgagaccgucgccaucgaccgccccgccgagguccgcaaggucugcuacaacgccguccucacccacgucaagaucaacgacaagugccccuccaccggcgaggcccaccucgccgaggagaacgagggcgacaacgccugcaagcgcaccuacuccgaccgcggcuggggcaacggcugcggccucuucggcaagggcuccaucgucgccugcgccaaguucaccugcgccaaguccaugucccucuucgaggucgaccagaccaagauccaguacgucauccgcgcccagcuccacgucggcgccaagcaggagaacuggaacaccgacaucaagacccucaaguucgacgcccucuccggcucccaggaggucgaguucaucggcuacggcaaggccacccucgagugccagguccagaccgccgucgacuucggcaacuccuacaucgccgagauggagaccgaguccuggaucgucgaccgccagugggcccaggaccucacccuccccuggcaguccggcuccggcggcgucuggcgcgagaugcaccaccucgucgaguucgagcccccccacgccgccaccauccgcguccucgcccucggcaaccaggagggcucccucaagaccgcccucaccggcgccaugcgcgucaccaaggacaccaacgacaacaaccucuacaagcuccacggcggccacgucuccugccgcgucaagcucuccgcccucacccucaagggcaccuccuacaagaucugcaccgacaagauguucuucgucaagaaccccaccgacaccggccacggcaccgucgucaugcaggucaaggucuccaagggcgcccccugccgcauccccgucaucgucgccgacgaccucaccgccgccaucaacaagggcauccucgucaccgucaaccccaucgccuccaccaacgacgacgagguccucaucgaggucaacccccccuucggcgacuccuacaucaucgucggccgcggcgacucccgccucaccuaccaguggcacaaggagggcuccuccaucggcaagcucuucacccagaccaugaagggcgucgagcgccucgccgucaugggcgacaccgccugggacuucuccuccgccggcggcuucuucaccuccgucggcaagggcauccacaccgucuucggcuccgccuuccagggccucuucggcggccucaacuggaucaccaaggucaucaugggcgccguccucaucugggucggcaucaacacccgcaacaugaccauguccauguccaugauccucgucggcgucaucaugauguuccucucccucggcgucggcgccgaccagggcugcgccaucaacuucggcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 30589 - RNA, 2311 nt, Artificial Sequence
  mRNA product comprising derived and/or modified sequence from YFV(17D)__prME R7251
gggagaaagcuuaccaugagaggccugagcagcagaaagagaagaagccacgacgugcugaccgugcaguuccugauccugggcaugcugcugaugaccggcggcgugacccuggugagaaagaacagauggcugcugcugaacgugaccagcgaggaccugggcaagaccuucagcgugggcaccggcaacugcaccaccaacauccuggaggccaaguacuggugccccgacagcauggaguacaacugccccaaccugagccccagagaggagcccgacgacaucgacugcuggugcuacggcguggagaacgugagaguggccuacggcaagugcgacagcgccggcagaagcagaagaagcagaagagccaucgaccugcccacccacgagaaccacggccugaagaccagacaggagaaguggaugaccggcagaaugggcgagagacagcugcagaagaucgagagaugguucgugagaaaccccuucuucgccgugaccgcccugaccaucgccuaccuggugggcagcaacaugacccagagaguggugaucgcccugcuggugcuggccgugggccccgccuacagcgcccacugcaucggcaucaccgacagagacuucaucgagggcgugcacggcggcaccugggugagcgccacccuggagcaggacaagugcgugaccgugauggcccccgacaagcccagccuggacaucagccuggagaccguggccaucgacagacccgccgaggugagaaaggugugcuacaacgccgugcugacccacgugaagaucaacgacaagugccccagcaccggcgaggcccaccuggccgaggagaacgagggcgacaacgccugcaagagaaccuacagcgacagaggcuggggcaacggcugcggccuguucggcaagggcagcaucguggccugcgccaaguucaccugcgccaagagcaugagccuguucgagguggaccagaccaagauccaguacgugaucagagcccagcugcacgugggcgccaagcaggagaacuggaacaccgacaucaagacccugaaguucgacgcccugagcggcagccaggagguggaguucaucggcuacggcaaggccacccuggagugccaggugcagaccgccguggacuucggcaacagcuacaucgccgagauggagaccgagagcuggaucguggacagacagugggcccaggaccugacccugcccuggcagagcggcagcggcggcguguggagagagaugcaccaccugguggaguucgagcccccccacgccgccaccaucagagugcuggcccugggcaaccaggagggcagccugaagaccgcccugaccggcgccaugagagugaccaaggacaccaacgacaacaaccuguacaagcugcacggcggccacgugagcugcagagugaagcugagcgcccugacccugaagggcaccagcuacaagaucugcaccgacaagauguucuucgugaagaaccccaccgacaccggccacggcaccguggugaugcaggugaaggugagcaagggcgcccccugcagaauccccgugaucguggccgacgaccugaccgccgccaucaacaagggcauccuggugaccgugaaccccaucgccagcaccaacgacgacgaggugcugaucgaggugaacccccccuucggcgacagcuacaucaucgugggcagaggcgacagcagacugaccuaccaguggcacaaggagggcagcagcaucggcaagcuguucacccagaccaugaagggcguggagagacuggccgugaugggcgacaccgccugggacuucagcagcgccggcggcuucuucaccagcgugggcaagggcauccacaccguguucggcagcgccuuccagggccuguucggcggccugaacuggaucaccaaggugaucaugggcgccgugcugaucugggugggcaucaacaccagaaacaugaccaugagcaugagcaugauccuggugggcgugaucaugauguuccugagccugggcgugggcgccgaccagggcugcgccaucaacuucggcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 30590 - RNA, 2311 nt, Artificial Sequence
  mRNA product comprising derived and/or modified sequence from YFV(17D)__prME R6860
gggagaaagcuuaccaugagaggccugagcuccaggaagcggcgcucucacgacgugcucaccguccaguuccuuauccuggggauguuguuaaugacaggagguguuacucuggugcgaaaaaaccguuggcuacuccugaauguaacgucagaggaucuuggcaagaccuuuaguguggggacaggaaacugcacuaccaauauucuggaagccaaauacuggugucccgacagcauggaguauaacugcccuaauuuguccccaagagaagagccggaugacauagauuguuggugcuacggcgucgaaaacgugaggguugcuuaugguaagugugacucugcagggcggucgcgcagaucaaggcgggccaucgaucuccccacacaugagaaucacggacugaaaacccgccaagagaaguggaugacuggccgaaugggcgaaagacagcugcagaagauugagaggugguucgugcggaacccuuuuuucgcggucacagcucucaccaucgccuacuuaguggggagcaauaugacgcagcguguaguuauugcacugcuuguguuggccgucggaccagcuuauagugcacauugcaucgguauaacugaccgcgauuuuaucgaaggcgugcacgggggaaccuggguguccgccacacuggagcaagacaaaugugucacuguuauggcucccgauaagccuucucuagacauuagccucgagaccguggccaucgauagaccagcggaaguaaggaaagugugcuacaacgcaguccugacacaugugaagauuaaugacaaaugucccuccaccggcgaggcccaccuugcugaagagaacgaaggugacaaugccugcaagcggacguauucagaucgaggguggggaaacggcuguggccuguucgggaagggaaguaucguugcaugcgcuaaauuuacuugcgccaagagcaugucuuuguucgagguggaccagacaaaaauacaguacgucauucgcgcgcagcuccacgugggugccaagcaagagaauuggaacaccgauaucaaaacucugaaguuugacgcauuauccggcucacaggaaguagaguucauuggguacggaaaagcuacacuggaaugucagguucagaccgccguggauuuuggcaacagcuauaucgcugagauggaaacggagaguuggaucgucgacagacaaugggcccaggaucucacccuuccuuggcagucugguuccgggggcguguggagggagaugcaucaccuggucgaguucgaaccaccgcaugcagccacaauucggguguuggcucuaggaaaucaagaaggcagccugaagacugcgcucaccggggcaaugcgcguuacaaaggacacuaacgauaauaaccuguacaaacuucacggaggucacgugucgugcagaguaaagcugucugccuugacccucaaaggcacauccuauaagauauguaccgacaaaauguuuuucgucaagaaucccacugauacggggcauggaacagugguuaugcaggugaaggucucaaaaggcgcuccuugcaggaucccagugauuguagccgacgaccugaccgcagccaucaacaaggguauauuagugacuguuaaucccauugcuaguaccaacgaugacgagguccugaucgaagugaauccuccauucggggauagcuacaucauugugggccguggagacucccggcuaacauaucaguggcacaaagagggcucuagcaucgggaagcucuuuacccagacuaugaaaggagucgagcgacuggccguuaugggugauacagcaugggacuucucaagugcgggcggguuuuucacguccgugggaaagggcauucauaccguguuugguagcgcuuuccaagggcuuuuuggcggauugaacuggauaacuaagguaaucaugggcgccguccugauuuggguggggaucaauacaagaaacaugaccaugucuaugucaaugauccucguuggagugauuaugauguuccugagucuuggcgucggugcagaucaggggugugccauaaauuuuggaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 30591 - RNA, 2311 nt, Artificial Sequence
  mRNA product comprising derived and/or modified sequence from YFV(17D)__prME R7253
gggagaaagcuuaccaugcggggacuaagcagcagaaaaagacgcagccacgaugugcucaccgugcaauuccucauacuggggaugcuccuaaugaccggaggcgugacccuaguaaggaaaaacagauggcuacuacuaaacguaaccucagaagaucuaggaaagacauuuucagucggcacaggcaacugcacaaccaacauacuagaagcaaaauauuggugcccagacagcauggaauacaacugucccaaccucagcccaagagaggaaccagacgacauagacugcugguguuacggaguagaaaacguaagaguggcauacggcaaaugcgacagcgcaggcaggagccgaagaucccgcagagccaucgacuugcccacgcacgaaaaccacggccucaaaacacgacaagaaaaauggaugacagggcgaaugggagaacgacagcuccagaaaauagaacgaugguucguccggaacccguucuucgcaguaacggcacuaacaaucgcauaccucguaggcagcaacaugacacaaagaguggucaucgcgcuacucguacuagcaguggggcccgcauacagugcacacugcauaggaaucacagaccgugacuucaucgaaggcguacacggaggaacguggguaagcgcgacacuggaacaagacaaaugcgugacaguaauggcaccagacaaaccaagccuagacauaucccuagaaacggucgccaucgaccgucccgcagaaguacgaaagguaugcuauaaugcaguccucacacacgucaaaauaaacgacaaaugccccagcacgggcgaagcacaccucgccgaagaaaacgaaggggauaacgcgugcaaacgcaccuacuccgacaggggauggggcaacggaugcggacuguucggaaaaggauccauagucgcaugcgcaaaauuuaccugcgcaaaaagcaugagcuuguucgagguagaccaaacgaagauccaauacguaauccgagcucaacuacacguuggggccaagcaagagaacuggaauacggacaucaaaacacuaaaauucgacgcacucuccggcucacaagaagucgaguucaucggcuacggcaaagcaacacuagaaugccaaguacaaacagcgguggacuucggcaacagcuacauagcagaaauggaaacagaaagcuggauaguagaccgacaaugggcacaagaccuaacucugccauggcaaagcggcucaggaggaguguggagagagaugcaccaccugguagaguucgaacccccacacgcagcaacaauaaggguacuggcacuaggcaaccaagaaggcagccuaaaaaccgcacucacaggagccaugcgcgugacgaaggacaccaacgacaacaaccucuacaaacuccacggagggcacguauccugccgcguaaaacuaucagcacuaacgcuaaaaggaacaagcuacaaaauaugcacagacaaaauguucuucgucaaaaaccccacagacacaggccacggcacagucguaaugcaagugaaggucagcaagggggcccccugccgaaucccagucauaguggcagacgaccucacggccgccaucaacaaagggauccugguaacagugaacccaauagcaucgaccaacgacgacgaaguccucauagaagugaaucccccguucggcgacagcuacaucaucguaggacgcggcgacucccgacugacguaccaauggcauaaagaaggcagcagcauuggaaaacuauucacccaaaccaugaagggcgucgaaagacucgcggugaugggagacaccgcaugggacuucucgagcgcaggcggcuucuucacaagcguaggaaaagggauucacacaguauucggauccgcauuccaaggccucuucgggggacuaaacuggauaacgaaaguaauaaugggagcaguucucauauggguaggaaucaacacacgaaacaugacaauguccaugucaaugauacucguaggcguaaucaugauguuucugucacucggagugggagcagaccaagguugcgccauaaacuucggcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 30592 - RNA, 2311 nt, Artificial Sequence
  mRNA product comprising derived and/or modified sequence from YFV(17D)__prME R7252
gggagaaagcuuaccaugagaggauuaucaaguagaaaaagaagaucacaugauguacuaaccgugcaauuuuugaucuuagggaugcucuuaaugacaggagguguuacauuaguaagaaagaaucgauggcugcuuuuaaaugugacaucagaggauuuagggaaaacauuuucgguaggaacaggaaauuguacuacaaauauacuugaagcaaaauauuggugcccagacucuauggaauauaauuguccaaauuuaaguccuagagaagaaccugacgauauagauuguugguguuaugguguagaaaauguaagaguagcauacggcaaaugcgauagugcaggacguucuagacguucaaggagagccauagaucugcccacucacgaaaaucacggauugaaaacacgacaagaaaaauggaugacugggcgaaugggagaaagacaacuacagaaaauugaaagaugguucguuagaaauccauucuuugccguaacagcuuuaacaauagccuauuuaguagguaguaauaugacacaaagaguaguaauagcauugcuaguguuagcaguuggaccagcuuauagugcacauugcauaggaauaacagauagagacuuuauagaaggaguacacgggggaacuuggguaagugccacuuuagaacaagauaaauguguuacagugauggcgccagauaaaccaagucuggacauaaguuuggaaacaguagcgauugauagacccgcagaaguaagaaaaguuuguuauaaugcuguucuaacccauguuaaaauaaaugauaaaugcccuagcaccggagaagcccaucuagcagaagaaaaugaaggagauaacgcauguaaacgaacauacucagauagaggauggggcaacggauguggcuuguuuggaaaagguagcauaguagcaugcgcuaaauuuacaugcgcaaagucaaugucauuauuugaaguagaucaaacaaaaauacaauauguaauaagagcucaauuacacgugggugcaaaacaagaaaauuggaauacagacauaaagacacuaaaguucgacgcauuaaguggaucacaagagguagaauuuauaggguacggaaaagcgacuuuagagugucaaguccaaacagcaguagauuucgguaacucauacauagcagaaauggaaacugaaaguuggauaguagauagacaaugggcacaagacuugacacuaccuuggcaaucaggaagcggaggaguauggagagaaaugcaucauuuaguagaauuugaaccaccucaugcagcaacaauaagaguauuagcccuaggaaaccaagaaggaaguuuaaaaacagcacuaacaggagcuaugagaguaacaaaagauacaaaugacaacaaucuauacaaauuacacggaggacauguaagcugccggguaaaguugagcgcacuaacauuaaaaggaacgaguuauaaaauaugcacagauaaaauguucuuuguuaaaaauccuacagauaccggucauggaacaguaguaaugcaaguaaaaguaaguaaaggcgcucccuguagaauaccuguaauagucgcagacgauuuaaccgcagcaauaaauaaaggaauauuagucacgguaaacccaauagcgucaacaaaugaugaugaaguauuaauagaaguuaacccaccuuuuggagacaguuauauaauagucggaaggggugauaguagacuaacauaccaauggcauaaagaaggaagcucaauaggaaaauuauuuacucaaaccaugaaagguguagaaaggcuagcuguuaugggugacacagcaugggauuuuucaagcgcaggaggguucuuuacaucaguagguaaaggaauacauacaguauuuggaagugcauuucaaggauuauuuggugguuuaaauuggauaacaaaaguaauaaugggcgcaguuuuaauauggguagguauaaacacaagaaauaugacaaugucuaugaguaugauauuggucggaguaauaaugauguuuuuaucacuaggagugggugcagaucaagguugcgcuauuaauuuuggaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu
